US011078293B2

(12) United States Patent
Sonoda et al.

(10) Patent No.: US 11,078,293 B2
(45) Date of Patent: *Aug. 3, 2021

(54) ANTI-HUMAN TRANSFERRIN RECEPTOR ANTIBODY CAPABLE OF PENETRATING BLOOD-BRAIN BARRIER

(71) Applicant: JCR Pharmaceuticals Co., Ltd., Hyogo (JP)

(72) Inventors: Hiroyuki Sonoda, Kobe (JP); Kenichi Takahashi, Kobe (JP)

(73) Assignee: JCR Pharmaceuticals Co., Ltd., Hyogo (JP)

( * ) Notice: Subject to any disclaimer, the term of this patent is extended or adjusted under 35 U.S.C. 154(b) by 0 days.

This patent is subject to a terminal disclaimer.

(21) Appl. No.: 16/909,398

(22) Filed: Jun. 23, 2020

(65) Prior Publication Data

US 2020/0317798 A1    Oct. 8, 2020

Related U.S. Application Data

(63) Continuation of application No. 16/473,446, filed as application No. PCT/JP2017/046762 on Dec. 26, 2017, now Pat. No. 10,759,864.

(30) Foreign Application Priority Data

Dec. 26, 2016  (JP) .............................. JP2016-252148

(51) Int. Cl.
| C07K 16/28 | (2006.01) |
| A61K 47/68 | (2017.01) |
| C07K 16/46 | (2006.01) |
| C12N 9/16 | (2006.01) |
| C12N 15/62 | (2006.01) |

(52) U.S. Cl.
CPC ...... *C07K 16/2881* (2013.01); *A61K 47/6809* (2017.08); *A61K 47/6813* (2017.08); *A61K 47/6815* (2017.08); *C07K 16/2806* (2013.01); *C07K 16/46* (2013.01); *C12N 9/16* (2013.01); *C12N 15/62* (2013.01); *C07K 2317/55* (2013.01); *C07K 2317/565* (2013.01); *C07K 2317/622* (2013.01)

(58) Field of Classification Search
None
See application file for complete search history.

(56) References Cited

U.S. PATENT DOCUMENTS

| 5,154,924 A | 10/1992 | Friden |
| 5,442,043 A | 8/1995 | Fukuta et al. |
| 5,527,527 A | 6/1996 | Friden |
| 5,977,307 A | 11/1999 | Friden et al. |
| 6,472,147 B1 | 10/2002 | Janda et al. |
| 2004/0101904 A1 | 5/2004 | Pardridge et al. |
| 2010/0077498 A1 | 3/2010 | Pardridge et al. |
| 2010/0266613 A1 | 10/2010 | Harding et al. |
| 2011/0110935 A1 | 5/2011 | Pardridge et al. |
| 2012/0171120 A1 | 7/2012 | Dennis et al. |
| 2012/0231023 A1 | 9/2012 | Zurawski et al. |
| 2013/0171061 A1 | 7/2013 | Yang et al. |
| 2015/0110791 A1 | 4/2015 | Zhang et al. |
| 2016/0369001 A1 | 12/2016 | Sonoda et al. |
| 2017/0044259 A1 | 2/2017 | Tipton et al. |
| 2017/0252458 A1 | 9/2017 | Albone et al. |
| 2017/0355756 A1 | 12/2017 | Julien et al. |
| 2018/0171012 A1 | 6/2018 | Sonoda et al. |
| 2018/0179291 A1 | 6/2018 | Sonoda et al. |
| 2019/0338043 A1 | 11/2019 | Sonoda et al. |

FOREIGN PATENT DOCUMENTS

| CA | 2607771 A1 | 5/2009 |
| CA | 3034589 A1 | 3/2018 |
| CN | 101245107 A | 8/2008 |
| CN | 103502273 A | 1/2014 |
| EP | 3563863 A1 | 11/2019 |
| EP | 3679945 A1 | 7/2020 |
| JP | H05-500944 A | 2/1993 |
| JP | H06-228199 A | 8/1994 |
| JP | 2006-511516 A | 4/2006 |
| JP | 2007-504166 A | 3/2007 |
| JP | 2009-515819 A | 4/2009 |
| JP | 2009-525963 A | 7/2009 |
| JP | 2011-144178 A | 7/2011 |
| JP | 2012-062312 A | 3/2012 |
| JP | 2014-514313 A | 6/2014 |
| JP | 2018-033454 A | 3/2018 |
| WO | 91/003259 A1 | 3/1991 |
| WO | 95/02421 A1 | 1/1995 |

(Continued)

OTHER PUBLICATIONS

Pardridge et al., "Reengineering Biopharmaceuticals for Targeted Delivery Across the Blood-Brain Barrier," Methods in Enzymology, 503: 269-292 (2012).
Torres et al., "The immunoglobulin constant region contributes to affinity and specificity," Trends in Immunology 29: 91-97 (2007).
Pardridge, "Blood-brain barrier drug delivery of IgG fusion proteins with a transferrin receptor monoclonal antibody," Expert Opinion Drug Drug Delivery, 12: 207-222 (2015).
Yan et al., "Studies of the Expression and Biologic Activity of an Anti-transferrin Receptor ScFv-BDNF Fusion Protein," China Biotechnology, 26: 1-5 (2006) (see English abstract).
Extended European Search Report issued in counterpart European Patent Application No. 16814465.7 dated May 8, 2019.
Bowie et al., "Deciphering the Message in Protein Sequences: Tolerance to Amino Acid Substitutions," Science, 247: 1306-1310 (1990).

(Continued)

*Primary Examiner* — Adam Weidner
(74) *Attorney, Agent, or Firm* — Morgan, Lewis & Bockius LLP

(57) ABSTRACT

Provided is an anti-human transferrin receptor antibody or an analog thereof, wherein in the heavy chain variable region of the antibody, (a) CDR1 comprises the amino acid sequence set forth as SEQ ID NO: 62 or SEQ ID NO: 63, (b) CDR2 comprises the amino acid sequence set forth as SEQ ID NO: 13 or SEQ ID NO: 14, and (c) CDR3 comprises the amino acid sequence set forth as SEQ ID NO: 15 or SEQ ID NO: 16, and an analogue thereof.

47 Claims, 12 Drawing Sheets

Specification includes a Sequence Listing.

(56) References Cited

FOREIGN PATENT DOCUMENTS

| WO | 02/031510 A1 | 4/2002 |
| --- | --- | --- |
| WO | 02/034771 A2 | 5/2002 |
| WO | 03/083069 A2 | 10/2003 |
| WO | 2004/050016 A2 | 6/2004 |
| WO | 2005/021064 A2 | 3/2005 |
| WO | 2007/044323 A2 | 4/2007 |
| WO | 2007/084737 A2 | 7/2007 |
| WO | 2008/068048 A2 | 6/2008 |
| WO | 2010/037395 A2 | 4/2010 |
| WO | 2012/075037 A1 | 6/2012 |
| WO | 2012/143379 A1 | 10/2012 |
| WO | 2013/177062 A2 | 11/2013 |
| WO | 2014/105810 A1 | 7/2014 |
| WO | 2014/189973 A2 | 11/2014 |
| WO | 2014/190305 A2 | 11/2014 |
| WO | 2014/194282 A2 | 12/2014 |
| WO | 2015/009961 A1 | 1/2015 |
| WO | 2015/098989 A1 | 7/2015 |
| WO | 2016/208695 A1 | 12/2016 |
| WO | 2016/208696 A1 | 12/2016 |
| WO | 2017/011580 A2 | 1/2017 |
| WO | 2019/049967 A1 | 3/2019 |

OTHER PUBLICATIONS

Pawson et al., "Assembly of Cell Regulatory Systems Through Protein Interaction Domains," Science, 300: 445-452 (2003).
Burgess et al., "Possible Dissociation of the Heparin-binding and Mitogenic Activities of the Heparin-binding (Acidic Fibroblast) Growth Factor-1 form Its Receptor-binding Activities by Site-directed Mutagenesis of a Single Lysine Residue," Journal of Cell Biology, 111: 2129-2138 (1990).
Alaoui-Ismaili et al., "Design of second generation therapeutic recombinant bone morphogenetic proteins," Cytokine & Growth Factor Reviews, 20: 501-507 (2009).
Guo et al., "Protein tolerance to random amino acid change," PNAS, 101: 9205-9210 (2004).
Rudikoff et al., "Single amino acid substitution altering antigen-binding specificity," PNAS, 79: 1979-1983 (1982).
Holm et al., "Functional mapping and single chain construction of the anti-cytokeratin 8 monoclonal antibody TS1," Molecular Immunology, 44: 1075-1084 (2007).
Holmes et al., "Structural Consequences of Humanizing an Antibody," Journal of Immunology, 2192-2201 (1997).
MacCallum et al., "Antibody-antigen Interactions: Contact Analysis and Binding Site Topography," Journal of Molecular Biology, 262: 732-745 (1996).
de Pascalis et al., "Grafting of "Abbreviated" Complementarity-Determining Regions Containing Specificity-Determining Residues Essential for Ligand Contact to Engineer a Less Immunogenic Humanized Monoclonal Antibody," Journal of Immunology, 169: 3076-3084 (2002).
Casset et al., "A peptide mimetic of an anti-CD4 monoclonal antibody by rational design," Biochemical and Biophysical Research Communications, 307: 198-205 (2003).
Vajdos et al., "Comprehensive Functional Maps of the Antigen-binding Site of an Anti-ErbB2 Antibody Obtained with Shotgun Scanning Mutagenesis," Journal of Molecular Biology, 320: 415-428 (2002).
Chen et al., "Selection and Analysis of an Optimized Anti-VEGF Antibody: Crystal Structure of an Affinity-matured Fab in Complex with Antigen," Journal of Molecular Biology, 293: 865-881 (1999).
Wu et al., "Humanization of a Murine Monoclonal Antibody by Simultaneous Optimization of Framework and CDR Residues," Journal of Molecular Biology, 294: 151-162 (1999).
Chao, "Neurotrophins and their receptors: a convergence point for many signalling pathways," Nature Reviews Neurosicence, 4: 299-309 (2003).
Tabakman et al., "Interactions between the cells of the immune and nervous system: neurotrophins as neuroprotection mediators in CNS injury," Progress in Brain Research, 146: 387-401 (2004).
Bollen et al., "7,8-Dihydroxyflavone improves memory consolidation processes in rats and mice," Behavioural Brain Research, 257: 8-12 (2013).
Altar et al., "Efficacy of brain-derived neurotrophic factor and neurotrophin-3 on neurochemical and behavioral deficits associated with partial nigrostriatal dopamine lesions," Journal of Neurochemistry, 63: 1021-1032 (1994).
Zuccato et al., "Role of brain-derived neurotrophic factor in Huntington's disease," Progress in Neurobiology, 81:294-330 (2007).
Wu, "Neuroprotection in experimental stroke with targeted neurotrophins," The Journal of the American Society for Experimental Neurotherapeutics, 2: 120-128 (2005).
Katz, Brain-derived neurotrophic factor and Rett syndrome, The Handbook of Experimental Pharmacology, 220: 481-495 (2014).
Castren, "Neurotrophins and psychiatric disorders," The Handbook of Experimental Pharmacology, 220: 461-479 (2014).
Boado et al., "Genetic Engineering, Expression, and Activity of a Fusion Protein of a Human Neurotrophin and a Molecular Trojan Horse for Delivery Across the Human Blood-Brain Barrier," Biotechnology and Bioengineering, 97: 1376-1386 (2007).
Wu et al., "Neuroprotection with noninvasive neurotrophin delivery to the brain," Proceedings of the National Academy of Sciences, 96: 254-259 (1999).
Gosk et al, "Targeting Anti-Transferrin Receptor Antibody (OX26) and OX26-Conjugated Liposomes to Brain Capillary Endothelial Cells Using In Situ Perfusion," Journal of Cerebral Blood Flow & Metabolism, 24: 1193-1196 (2004).
Li et al., "The role of the transferrin-transferrin-receptor system in drug delivery and targeting," Trends in Pharmacological Sciences, 23: 206-209 (2002).
Helguera et al., "An Antibody Recognizing the Apical Domain of Human Transferrin Receptor 1 Efficiently Inhibits the Entry of All New World Hemorrhagic Fever Arenaviruses," Journal of Virology, 86: 4024-4028 (2012).
Partial Supplemental European Search Report issued in counterpart European Patent Application No. 16814464.0 dated Dec. 17, 2018.
Qing et al., "The in vitro antitumor effect and in vivo tumor-specificity distribution of human-mouse chimeric antibody against transferrin receptor", Cancer Immunology Immunotherapy, 55: 1111-1121 (2006).
Tucker et al., "Drug delivery to the brain via the blood-brain barrier: a review of the literature and some recent patent disclosures," Therapeutic Delivery, 2: 311-327 (2011).
Extended European Search Report issued in counterpart European Patent Application No. 16814464.0 dated Mar. 25, 2019.
Niewoehner et al., "Increased Brain Penetration and Potency of a Therapeutic Antibody Using a Monovalent Molecular Shuttle," Neuron 81:49-60 (2014).
Office Action issued in counterpart Singapore Patent Application No. 11201710734U dated Jan. 3, 2019.
Formica et al., "5-Fluorouracil can cross brain-blood barrier and cause encephalopathy: should we expect the same from capecitabine? A case report on capecitabine-induced central neurotoxicity progressing to coma," Cancer Chemotherapy and Pharmacology, 58: 276-278 (2006).
International Search Report issued in corresponding International Patent Application No. PCT/JP2016/068739 dated Sep. 6, 2016.
International Preliminary Report on Patentability and Written Opinion issued in corresponding International Patent Application No. PCT/JP2016/068739 dated Jan. 4, 2018.
International Search Report issued in corresponding International Patent Application No. PCT/JP2016/068738 dated Sep. 6, 2016.
International Preliminary Report on Patentability and Written Opinion issued in corresponding International Patent Application No. PCT/JP2016/068738 dated Dec. 26, 2017.
International Search Report issued in corresponding International Patent Application No. PCT/JP2017/046735 dated Apr. 3, 2018.
International Preliminary Report on Patentability and Written Opinion issued in corresponding International Patent Application No. PCT/JP2017/046735 dated Jul. 11, 2019.

(56) References Cited

OTHER PUBLICATIONS

Xie et al., "Transport of nerve growth factor encapsulated into liposomes across the blood-brain barrier: In vitro and in vivo studies," Journal of Controlled Release, 105: 106-119 (2005).

Ou et al., "High-Dose Enzyme Replacement Therapy in Murine Hurler Syndrome," Molecular Genetics and Metabolism, 111: 116-122 (2014).

Li et al., "Genetically engineered brain drug delivery vectors: cloning, expression and in vivo application of an anti-transferrin receptor single chain antibody-streptavidin fusion gene and protein," Protein Engineering, 12: 787-796 (1999).

Bien-Ly et al., "Transferrin receptor (TfR) trafficking determines brain uptake of TfR antibody affinity variants," Journal of Experimental Medicine, 211: 233-244 (2014).

Sade et al., "A Human Blood-Brain Barrier Transcytosis Assay Reveals Antibody Transcytosis Influenced by pH-Dependent Receptor Binding," PLOS One, 9: e96340 (2014).

Zhou et al., "Monoclonal Antibody-Glial-Derived Neurotrophic Factor Fusion Protein Penetrates the Blood-Brain Barrier in the Mouse," Drug Metabolism and Disposition, 38: 566-572 (2010).

Zhou et al., "Delivery of a Peptide Radiopharmaceutical to Brain with an IgG-Avidin Fusion Protein," Bioconjugate Chemistry, 22: 1611-1618 (2011).

Boado et al., "Engineering and Expression of a Chimeric Transferrin Receptor Monoclonal Antibody for Blood-Brain Barrier Delivery in the Mouse," Biotechnology and Bioengineering, 102: 1251-1258 (2009).

Friden et al., "Characterization, Receptor Mapping and Blood-Brain Barrier Transcytosis of Antibodies to the Human Transferrin Receptor," Journal of Pharmacology and Experimental Therapeutics, 278: 1491-1498 (1996).

Walus et al., "Enhanced Uptake of rsCD4 across the Rodent and Primate Blood-Brain Barrier after Conjugation to Anti-Transferrin Receptor Antibodies," Journal of Pharmacology and Experimental Therapeutics, 277: 1067-1075 (1996).

International Search Report issued in corresponding International Patent Application No. PCT/JP2017/046762 dated Mar. 27, 2018.

International Preliminary Report on Patentability and Written Opinion issued in corresponding International Patent Application No. PCT/JP2017/046762 dated Jul. 11, 2019.

Kussie, "A Single Engineered Amino Acid Substitution Changes Antibody Fine Specificity," Journal of Immunology, 152: 146-152 (1994).

Chen et al., "Enhancement and destruction of antibody function by somatic mutation: unequal occurrence is controlled by V gene combinatorial associations," EMBO Journal, 14: 2784-2794 (1995).

Extended European Search Report issued in counterpart European Patent Application No. 17889016.6 dated Jul. 15, 2020.

Hiroyuki Sonoda et al., application of U.S. Appl. No. 16/473,816, filed Sep. 12, 2019.

Zhou et al., "Brain-Penetrating IgG Iduronate 2-Sulfatase Fusion Protein for the Mouse," Drug Metabolism and Disposition, 40: 329-335 (2012).

"Overview of the Immune System," Immunology: A Short Course, 7th ed., Richard Coico and Geoffrey Sunshine, 61-62 (2015).

Altshuler et al., "Generation of Recombinant Antibodies and Means for Increasing Their Affinity," Biochemistry (Moscow), 75 (13): 1584-1605 (2010). (Original Russian text: Uspekhi Biologicheskoi Khimii, 50: 203-258 (2010)).

Brown, et al., "Tolerance to Single, but Not Multiple, Amino Acid Replacements in Antibody VH CDR2," Journal of Immunology, 3286-3291 (1996).

Office Action issued in related Eurasian Patent Application No. 201991577 dated Feb. 26, 2021.

(a)
(b)
(c)
(d)
(e)

(a)

(b)

(c)

(d)

(e)

(a)

(b)

ANTI-HUMAN TRANSFERRIN RECEPTOR ANTIBODY CAPABLE OF PENETRATING BLOOD-BRAIN BARRIER

SEQUENCE LISTING SUBMISSION VIA EFS-WEB

A computer readable text file, entitled "SequenceListing.txt," created on or about Jun. 23, 2020 with a file size of about 1,079 kb contains the sequence listing for this application and is hereby incorporated by reference in its entirety.

TECHNICAL FIELD

The present invention relates to an anti-human transferrin receptor antibody to be utilized for conjugation with a compound that needs to exhibit its function in the central nervous system when administered parenterally (a protein or a low-molecular-weight compound and the like) in order to make that compound able to pass through the blood-brain barrier after parenterally administered, and also a method for production thereof, as well as a method of use thereof.

BACKGROUND ART

Unlike the capillaries in other tissues such as muscles, the capillaries that supply the blood to most of the brain tissues except some areas including the circumventricular organs (pineal gland, pituitary body, area postrema, etc.) differ in that the endothelial cells forming their endothelium are mutually connected by tight intercellular junctions. Passive transfer of substances from the capillaries to the brain is thereby restricted, and although there are some exceptions, substances are unlikely to move into the brain from the blood except such compounds as are lipid-soluble or of low-molecular-weight (less than 200-500 Dalton) and electrically neutral around the physiological pH. This system, which restricts exchange of substances between the blood and the tissue fluid of the brain through the endothelium of capillaries in the brain, is called the blood-brain barrier or BBB. The blood-brain barrier not only restricts exchange of substances between the blood and the brain but also between the tissue fluid of the central nervous system, including the brain and the spine, and the blood.

Owing to the blood-brain barrier, most of the cells of the central nervous system escape the effects of fluctuating concentrations of substances like hormones and lymphokines in the blood, and their biochemical homeostasis is thus maintained.

The blood-brain barrier, however, imposes a problem when it comes to develop pharmaceutical agents. For mucopolysaccharidosis type I (Hurler syndrome), an inherited metabolic disease caused by α-L-iduronidase deficiency, for example, although an enzyme replacement therapy is carried out by intravenous supplementation with a recombinant α-L-iduronidase as a therapy, the therapy is not effective for the notable abnormality observed in the central nervous system (CNS) in Hurler syndrome because the enzyme cannot pass through the blood-brain barrier.

Development of various methods has been attempted to make those macromolecular substances as proteins or the like, which need to be brought into function in the central nervous system, pass through the blood-brain barrier. In the case of nerve growth factor, for example, while attempts have been made for a method to cause the factor to pass through the blood-brain barrier by allowing liposomes encapsulating the factor to fuse with the cell membrane of endothelial cells in brain capillaries, they have not been materialized (Non Patent Literature 1). In the case of α-L-iduronidase, an attempt has been made to enhance the passive transfer of the enzyme through the blood-brain barrier by raising its blood concentration through an increased single dose of the enzyme, and it thus has been demonstrated, using a Hurler syndrome animal model, that the abnormality in the central nervous system (CNS) is ameliorated by that method (Non Patent Literature 2).

Furthermore, circumventing the blood-brain barrier, an attempt has also been made to administer a macromolecular substance directly into the medullary cavity or into the brain. For example, reports have been made about a method in which human α-L-iduronidase was administered into the medullary cavity of a patient with a Hurler syndrome (mucopolysaccharidosis type I) (Patent Literature 1), a method in which human acid sphingomyelinase was administered into the brain ventricles of a patient with Niemann-Pick disease (Patent Literature 2), and a method in which iduronate 2-sulfatase (I2S) was administered into the brain ventricles of Hunter syndrome model animals (Patent Literature 3). While it seems possible by one of such methods to definitely let a pharmaceutical agent act in the central nervous system, they have a problem as being highly invasive.

There have been reported various methods to let a macromolecular substance get into the brain through the blood-brain barrier, in which the macromolecular substance is modified to give it an affinity to membrane proteins occurring on the endothelial cells of the brain capillaries. Examples of those membrane proteins which occur on the endothelial cells of the brain capillaries include receptors for compounds such as insulin, transferrin, insulin-like growth factor (IGF-I, IGF-II), LDL, and leptin.

For example, a technique has been reported in which nerve growth factor (NGF) was synthesized into the form of a fusion protein with insulin, and this fusion protein was allowed to pass through the blood-brain barrier via its binding to the insulin receptor (Patent Literatures 4-6). Further, a technique has been reported in which nerve growth factor (NGF) was synthesized in the form of a fusion protein with anti-insulin receptor antibody, and this fusion protein was allowed to pass through the blood-brain barrier via its binding to the insulin receptor (Patent Literatures 4 and 7). Further, a technique has been reported in which nerve growth factor (NGF) was synthesized in the form of a fusion protein with transferrin, and this fusion protein was allowed to pass through the blood-brain barrier via its binding to the transferrin receptor (TfR) (Patent Literature 8). Further, a technique has been reported in which nerve growth factor (NGF) was synthesized in the form of a fusion protein with anti-transferrin receptor antibody (anti-TfR antibody), and this fusion protein is allowed to pass through the blood-brain barrier via its binding to TfR (Patent Literatures 4 and 9).

Looking further into the techniques that utilize an anti-transferrin receptor antibody, there has been reported that in the field of the technique to make a pharmaceutical agent pass through the blood-brain barrier by binding it to an anti-TfR antibody, a single-chain antibody could be used (Non Patent Literature 3). Further, it has been reported that anti-hTfR antibodies exhibiting relatively high dissociation constants with hTfR (low-affinity anti-hTfR antibody) could be favorably used in the technique to make pharmaceutical agents pass through the blood-brain barrier (Patent Literatures 10 and 11, and Non Patent Literature 4). Still further, it has also been reported that an anti-TfR antibodies whose affinity to hTfR varies depending on pH could be employed as a carrier for making pharmaceutical agents pass through the blood-brain barrier (Patent Literature 12, and Non Patent Literature 5).

CITATION LIST

Patent Literature

Patent Literature 1: JP2007-504166 A1
Patent Literature 2: JP2009-525963 A1
Patent Literature 3: JP2012-62312 A1
Patent Literature 4: U.S. Pat. No. 5,154,924 B1
Patent Literature 5: JP2011-144178 A1
Patent Literature 6: US2004/0101904 A1
Patent Literature 7: JP2006-511516 A1
Patent Literature 8: JPH06-228199 A1
Patent Literature 9: U.S. Pat. No. 5,977,307 B1
Patent Literature 10: WO 2012/075037
Patent Literature 11: WO 2013/177062
Patent Literature 12: WO 2012/143379

Non Patent Literature

Non Patent Literature 1: Xie Y. et al., J Control Release. 105. 106-19 (2005)
Non Patent Literature 2: Ou L. et al., Mol Genet Metab. 111. 116-22 (2014)
Non Patent Literature 3: Li J Y. Protein Engineering. 12. 787-96 (1999)
Non Patent Literature 4: Bien-Ly N. et al., J Exp Med. 211. 233-44 (2014)
Non Patent Literature 5: Sada H. PLoS ONE. 9. E96340 (2014)

SUMMARY OF INVENTION

Problems to be Solved by the Invention

Against the above background, it is an objective of the present invention to provide an anti-TfR antibody that can be utilized for conjugation with a compound that needs to exhibit its function in the central nervous system when administered parenterally (a protein or a low-molecular-weight compound and the like) in order to make that compound able to pass through the blood-brain barrier, and also a method for production thereof, as well as a method of use thereof.

Means for Solving the Problems

As a result of intense studies aimed at the above objective, the present inventors have found that anti-human transferrin receptor antibodies (anti-hTfR antibodies) that recognize the extracellular region of hTfR which are obtained by the method for antibody production described in detail in the specification, efficiently passes through the blood-brain barrier when administered to the body, and have completed the present invention thereupon. Thus the present invention provides what follows:

1. An anti-human transferrin receptor antibody, wherein in the heavy chain variable region of the antibody,
(a) CDR1 comprises the amino acid sequence set forth as SEQ ID NO: 62 or SEQ ID NO: 63,
(b) CDR2 comprises the amino acid sequence set forth as SEQ ID NO: 13 or SEQ ID NO: 14, and
(c) CDR3 comprises the amino acid sequence set forth as SEQ ID NO: 15 or SEQ ID NO: 16.

2. The antibody according to 1 above, wherein the framework region 3 of the heavy chain comprises the amino acid sequence set forth as SEQ ID NO: 64.

3. The antibody according to 1 or 2 above, wherein in the heavy chain variable region,
the CDR2 comprises an amino acid sequence having a homology not lower than 80% to the amino acid sequence set forth as SEQ ID NO: 13 or SEQ ID NO: 14, in place thereof, and
the CDR3 comprises an amino acid sequence having a homology not lower than 80% to the amino acid sequence set forth as SEQ ID NO: 15 or SEQ ID NO: 16, in place thereof.

4. The antibody according to 1 or 2 above, wherein in the heavy chain variable region,
the CDR2 comprises an amino acid sequence having a homology not lower than 90% to the amino acid sequence set forth as SEQ ID NO: 13 or SEQ ID NO: 14, in place thereof, and
the CDR3 comprises an amino acid sequence having a homology not lower than 90% to the amino acid sequence set forth as SEQ ID NO: 15 or SEQ ID NO: 16, in place thereof.

5. The antibody according to 1 or 2 above, wherein the heavy chain variable region comprises an amino acid sequence modified from at least one amino acid sequence of
(a) SEQ ID NO: 62 or SEQ ID NO: 63 as to the CDR1,
(b) SEQ ID NO: 13 or SEQ ID NO: 14 as to the CDR2,
(c) SEQ ID NO: 15 or SEQ ID NO: 16 as to the CDR3, and
(d) SEQ ID NO: 64 as to the framework region 3,
by the substitution, deletion or addition of 1 to 5 amino acids, in place thereof,
wherein in the CDR1, methionine positioned at position 5 from the N-terminal side of the amino acid sequence set forth as SEQ ID NO: 62 or SEQ ID NO: 63 is also located at the same position in the amino acid sequence thus modified, and
in the framework region 3, leucine positioned at position 17 from the N-terminal side of SEQ ID NO: 64 is also located at the same position in the amino acid sequence thus modified.

6. The antibody according to 1 or 2 above, wherein the heavy chain variable region comprises an amino acid sequence modified from at least one amino acid sequence of
(a) SEQ ID NO: 62 or SEQ ID NO: 63 as to the CDR1,
(b) SEQ ID NO: 13 or SEQ ID NO: 14 as to the CDR2,
(c) SEQ ID NO: 15 or SEQ ID NO: 16 as to the CDR3, and
(d) SEQ ID NO: 64 as to the framework region 3,
by the substitution, deletion or addition of 1 to 3 amino acids, in place thereof,
wherein in the CDR1, methionine positioned at position 5 from the N-terminal side of the amino acid sequence set forth as SEQ ID NO: 62 or SEQ ID NO: 63 is also located at the same position in the amino acid sequence thus modified, and
in the framework region 3, leucine positioned at position 17 from the N-terminal side of SEQ ID NO: 64 is also located at the same position in the amino acid sequence thus modified.

7. The antibody according to 2 above, wherein the heavy chain variable region comprises the amino acid sequence set forth as SEQ ID NO: 65.

8. The antibody according to 7 above, wherein the heavy chain variable region comprises, in a portion except for the amino acid sequences set forth as SEQ ID NO: 62 or SEQ ID NO: 63 of the CDR1 and SEQ ID NO: 64 of the framework region 3, an amino acid sequence having a homology not lower than 80% to the portion in place of the portion.

9. The antibody according to 7 above, wherein the heavy chain variable region comprises, in a portion except for the amino acid sequences set forth as SEQ ID NO: 62 or SEQ ID NO: 63 of the CDR1 and SEQ ID NO: 64 of the framework region 3, an amino acid sequence having a homology not lower than 90% to the portion in place of the portion.

10. The antibody according to 7 above, wherein the antibody comprises an amino acid sequence modified from the amino acid sequence constituting the heavy chain variable region, by the substitution, deletion or addition of 1 to 5 amino acids, in place thereof,
wherein in the CDR1, methionine positioned at position 5 from the N-terminus of the amino acid sequence set forth as SEQ ID NO: 63 is also located at the same position in the amino acid sequence thus modified, and in the framework region 3, leucine positioned at position 17 from the N-terminal side of SEQ ID NO: 64 is also located at the same position in the amino acid sequence thus modified.

11. The antibody according to 7 above, wherein the antibody comprises an amino acid sequence modified from the amino acid sequence constituting the heavy chain variable region, by the substitution, deletion or addition of 1 to 3 amino acids, in place thereof,
wherein in the CDR1, methionine positioned at position 5 from the N-terminus of the amino acid sequence set forth as SEQ ID NO: 63 is also located at the same position in the amino acid sequence thus modified, and in the framework region 3, leucine positioned at position 17 from the N-terminal side of SEQ ID NO: 64 is also located at the same position in the amino acid sequence thus modified.

12. The antibody according to 7 above, wherein the heavy chain comprises the amino acid sequence set forth as SEQ ID NO: 66 or SEQ ID NO: 68.

13. The antibody according to 12 above, wherein the heavy chain comprises an amino acid sequence having a homology not lower than 80% to a portion except for the amino acid sequences set forth as SEQ ID NO: 62 or SEQ ID NO: 63 of the CDR1 and SEQ ID NO: 64 of the framework region 3, in place of the portion.

14. The antibody according to 12 above, wherein the heavy chain comprises an amino acid sequence having a homology not lower than 90% to a portion except for the amino acid sequences set forth as SEQ ID NO: 62 or SEQ ID NO: 63 of the CDR1 and SEQ ID NO: 64 of the framework region 3, in place of the portion.

15. The antibody according to 12 above, wherein the antibody comprises an amino acid sequence modified from the amino acid sequence constituting the heavy chain, by the substitution, deletion or addition of 1 to 5 amino acids, in place thereof, wherein in the CDR1, methionine positioned at position 5 from the N-terminus of the amino acid sequence set forth as SEQ ID NO: 63 is also located at the same position in the amino acid sequence thus modified, and in the framework region 3, leucine positioned at position 17 from the N-terminal side of SEQ ID NO: 64 is also located at the same position in the amino acid sequence thus modified.

16. The antibody according to 12 above, wherein the antibody comprises an amino acid sequence modified from the amino acid sequence constituting the heavy chain, by the substitution, deletion or addition of 1 to 3 amino acids, in place thereof, wherein in the CDR1, methionine positioned at position 5 from the N-terminus of the amino acid sequence set forth as SEQ ID NO: 63 is also located at the same position in the amino acid sequence thus modified, and in the framework region 3, leucine positioned at position 17 from the N-terminal side of SEQ ID NO: 64 is also located at the same position in the amino acid sequence thus modified.

17. The antibody according to one of 1 to 16 above, wherein in the light chain variable region of the antibody,
(a) CDR1 comprises the amino acid sequence set forth as SEQ ID NO: 6 or SEQ ID NO: 7,
(b) CDR2 comprises the amino acid sequence set forth as SEQ ID NO: 8 or SEQ ID NO: 9, or the amino acid sequence Lys-Val-Ser, and
(c) CDR3 comprises the amino acid sequence set forth as SEQ ID NO: 10.

18. The antibody according to 17 above, wherein in the light chain variable region,
(a) the CDR1 comprises an amino acid sequence having a homology not lower than 80% to the amino acid sequence set forth as SEQ ID NO: 6 or SEQ ID NO: 7, in place thereof,
(b) the CDR2 comprises an amino acid sequence having a homology not lower than 80% to the amino acid sequence set forth as SEQ ID NO: 8 or SEQ ID NO: 9, or the amino acid sequence Lys-Val-Ser, in place thereof, and
(c) the CDR3 comprises an amino acid sequence having a homology not lower than 80% to the amino acid sequence set forth as SEQ ID NO: 10, in place thereof.

19. The antibody according to 17 above, wherein in the light chain variable region,
(a) the CDR1 comprises an amino acid sequence having a homology not lower than 90% to the amino acid sequence set forth as SEQ ID NO: 6 or SEQ ID NO: 7, in place thereof,
(b) the CDR2 comprises an amino acid sequence having a homology not lower than 90% to the amino acid sequence set forth as SEQ ID NO: 8 or SEQ ID NO: 9, or the amino acid sequence Lys-Val-Ser, in place thereof, and
(c) the CDR3 comprises an amino acid sequence having a homology not lower than 90% to the amino acid sequence set forth as SEQ ID NO: 10, in place thereof.

20. The antibody according to 17 above, wherein the light chain variable region comprises an amino acid sequence modified from at least one amino acid sequence of
(a) SEQ ID NO: 6 or SEQ ID NO: 7 as to the CDR1,
(b) SEQ ID NO: 8 or SEQ ID NO: 9, or the amino acid sequence Lys-Val-Ser as to the CDR2, and
(c) SEQ ID NO: 10 as to the CDR3,
by the substitution, deletion or addition of 1 to 5 amino acids, in place thereof.

21. The antibody according to 17 above, wherein the light chain variable region comprises an amino acid sequence modified from at least one amino acid sequence of
(a) SEQ ID NO: 6 or SEQ ID NO: 7 as to the CDR1,
(b) SEQ ID NO: 8 or SEQ ID NO: 9, or the amino acid sequence Lys-Val-Ser as to the CDR2, and
(c) SEQ ID NO: 10 as to the CDR3,
by the substitution, deletion or addition of 1 to 3 amino acids, in place thereof.

22. The antibody according to one of 1 to 16 above, wherein the light chain variable region of the antibody comprises the amino acid sequence set forth as SEQ ID NO:

17, SEQ ID NO: 18, SEQ ID NO: 19, SEQ ID NO: 20, SEQ ID NO: 21 or SEQ ID NO: 22.

23. The antibody according to 22 above, wherein the antibody comprises an amino acid sequence having a homology not lower than 80% to the amino acid sequence of the light chain variable region, in place thereof.

24. The antibody according to 22 above, wherein the antibody comprises an amino acid sequence having a homology not lower than 90% to the amino acid sequence of the light chain variable region, in place thereof.

25. The antibody according to 22 above, wherein the antibody comprises an amino acid sequence modified from the amino acid sequence of the light chain variable region by the substitution, deletion or addition of 1 to 5 amino acids, in place thereof.

26. The antibody according to 22 above, wherein the antibody comprises an amino acid sequence modified from the amino acid sequence of the light chain variable region by the substitution, deletion or addition of 1 to 3 amino acids, in place thereof.

27. The antibody according to one of 1 to 16 above, wherein the light chain of the antibody comprises the amino acid sequence set forth as SEQ ID NO: 23, SEQ ID NO: 25, SEQ ID NO: 27 or SEQ ID NO: 29.

28. The antibody according to 27 above, wherein the antibody comprises an amino acid sequence having a homology not lower than 80% to the amino acid sequence of the light chain, in place thereof.

29. The antibody according to 27 above, wherein the antibody comprises an amino acid sequence having a homology not lower than 90% to the amino acid sequence of the light chain, in place thereof.

30. The antibody according to 27 above, wherein the antibody comprises an amino acid sequence modified from the amino acid sequence of the light chain by the substitution, deletion or addition of 1 to 5 amino acids, in place thereof.

31. The antibody according to 27 above, wherein the antibody comprises an amino acid sequence modified from the amino acid sequence of the light chain by the substitution, deletion or addition of 1 to 3 amino acids, in place thereof.

32. The antibody according to one of 1 to 31 above, wherein the antibody has an affinity to both the extracellular region of human transferrin receptor and the extracellular region of monkey transferrin receptor.

33. The antibody according to 32 above, wherein the dissociation constant of its complex with the extracellular region of human transferrin receptor is not greater than $1 \times 10^{-10}$ M, and the dissociation constant of its complex with the extracellular region of monkey transferrin receptor is not greater than $1 \times 10^{-9}$ M.

34. The antibody according to one of 1 to 33 above, wherein the antibody is Fab antibody, F(ab')$_2$ antibody, or F(ab') antibody.

35. The anti-human transferrin receptor antibody according to one of 1 to 33 above, wherein the antibody is a single-chain antibody selected from the group consisting of scFab, scF(ab'), scF(ab')$_2$ and scFv.

36. The antibody according to 35 above, wherein the light chain and the heavy chain thereof are linked via a linker sequence.

37. The antibody according to 36 above, wherein the heavy chain is linked, via a linker sequence, to the light chain on the C-terminal side thereof.

38. The antibody according to 35 above, wherein the light chain is linked, via a linker sequence, to the heavy chain on the C-terminal side thereof.

39. The antibody according to one of 36 to 38 above, wherein the linker sequence consists of 8 to 50 amino acid residues.

40. The antibody according to 39 above, wherein the linker sequence is selected from the group consisting of the amino acid sequence Gly-Ser, the amino acid sequence Gly-Gly-Ser, the amino acid sequence Gly-Gly-Gly, the amino acid sequences set forth as SEQ ID NO: 3, SEQ ID NO: 4, and SEQ ID NO: 5, the amino acid sequence consisting of three consecutively linked amino acid sequences each set forth as SEQ ID NO: 3, and the amino acid sequences consisting of 1 to 10 thereof that are consecutively linked.

41. A fusion protein of an anti-human transferrin receptor antibody and a different protein (A), wherein
the anti-human transferrin receptor antibody is the antibody according to one of 1 to 40 above, and
the protein (A) is linked to the light chain of the antibody on the C-terminal side or the N-terminal side thereof.

42. The fusion protein according to 41 above, wherein the protein (A) is linked, directly or via a linker, to the light chain on the C-terminal side or the N-terminal side thereof.

43. The fusion protein according to 41 or 42 above, wherein the protein (A) is linked, via a linker, to the light chain on the C-terminal side or the N-terminal side thereof.

44. The fusion protein according to 43 above, wherein the linker is a peptide consisting of 1 to 50 amino acid residues.

45. The fusion protein according to 44 above, wherein the linker is a peptide comprising an amino acid sequence selected from the group consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

46. A fusion protein of an anti-human transferrin receptor antibody and a different protein (A), wherein
the anti-human transferrin receptor antibody is the antibody according to one of 1 to 40 above, and
the protein (A) is linked to the heavy chain of the antibody on the C-terminal side or the N-terminal side thereof.

47. The fusion protein according to 46 above, wherein the protein (A) is linked, directly or via a linker, to the heavy chain on the C-terminal side or the N-terminal side thereof.

48. The fusion protein according to 46 or 47 above, wherein the protein (A) is linked, via a linker, to the heavy chain on the C-terminal side or the N-terminal side thereof.

49. The fusion protein according to 48 above, wherein the linker sequence is a peptide consisting of 1 to 50 amino acid residues.

50. The fusion protein according to 49 above, wherein the linker is a peptide comprising an amino acid sequence selected from the group consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

51. The fusion protein according to one of 41 to 50 above, wherein the protein (A) is a protein originating from human.

52. The fusion protein according to one of 41 to 51 above, wherein the protein (A) is selected from the group consisting of nerve growth factor (NGF), lysosomal enzymes, ciliary neurotrophic factor (CNTF), glial cell line-derived neurotrophic factor (GDNF), neurotrophin-3, neurotrophin-4/5, neurotrophin-6, neuregulin-1, erythropoietin, darbepoetin, activin, basic fibroblast growth factor (bFGF), fibroblast growth factor 2 (FGF2), epidermal growth factor (EGF), vascular endothelial growth factor (VEGF), interferon α, interferon β, interferon γ, interleukin 6, granulocyte-macrophage colony stimulating factor (GM-CSF), granulocyte colony stimulating factor (G-CSF), macrophage colony stimulating factor (M-CSF), cytokines, tumor necrosis factor α receptor (TNF-α receptor), PD-1 ligands, PD-L1, PD-L2, enzymes having β-amyloid-degrading activity, anti-β-amyloid antibody, anti-BACE antibody, anti-EGFR antibody, anti-PD-1 antibody, anti-PD-L1 antibody, anti-PD-L2 antibody, anti-HER2 antibody, anti-TNF-α antibody, anti-CTLA-4 antibody, and other antibody medicines.

53. A fusion protein, wherein the protein (A) is a lysosomal enzyme, wherein the lysosomal enzyme is selected from the group consisting of α-L-iduronidase, iduronate 2-sulfatase, human acidic α-glucosidase, glucocerebrosidase, β-galactosidase, GM2 activator protein, β-hexosaminidase A, β-hexosaminidase B, N-acetylglucosamine-1-phosphotransferase, α-mannosidase, β-mannosidase, galactosylceramidase, saposin C, arylsulfatase A, α-L-fucosidase, aspartylglucosaminidase, α-N-acetylgalactosaminidase, acidic sphingomyelinase, α-galactosidase A, β-glucuronidase, heparan N-sulfatase, α-N-acetylglucosaminidase, acetyl CoA:α-glucosaminide N-acetyltransferase, N-Acetylglucosamine-6-sulfate sulfatase, acid ceramidase, amylo-1,6-glucosidase, sialidase, palmitoyl protein thioesterase 1, tripeptidyl-peptidase 1, hyaluronidase 1, CLN1 and CLN2.

54. The fusion protein according to one of 41 to 51 above, wherein the protein (A) is human iduronate 2-sulfatase, human acidic α-glucosidase, or human α-L-iduronidase.

55. The fusion protein according to 51 above, wherein the protein (A) is human acidic α-glucosidase, wherein
(1) the light chain of the antibody comprises the amino acid sequence set forth as SEQ ID NO: 23, and
(2) the heavy chain of the antibody is linked, on the C-terminal side thereof and via the amino acid sequence Gly-Ser, to the human acidic α-glucosidase, thereby forming the amino acid sequence set forth as SEQ ID NO: 57 or SEQ ID NO: 58.

56. The fusion protein according to 51 above, wherein the protein (A) is human acidic α-glucosidase, wherein
(1) the light chain of the antibody comprises the amino acid sequence set forth as SEQ ID NO: 23, and
(2) the heavy chain of the antibody comprises the amino acid sequence set forth as SEQ ID NO: 66 or SEQ ID NO: 68, and the heavy chain is linked, on the C-terminal side thereof and via the amino acid sequence Gly-Ser, to the human acidic α-glucosidase having the amino acid sequence set forth as SEQ ID NO: 55 or 56.

57. The fusion protein according to 51 above, wherein the protein (A) is human acidic α-glucosidase, wherein the antibody is Fab antibody, and wherein
(1) the light chain of the antibody comprises the amino acid sequence set forth as SEQ ID NO: 23, and
(2) the heavy chain of the antibody is linked, on the C-terminal side thereof and via the amino acid sequence consisting of three consecutively linked amino acid sequences each set forth as SEQ ID NO: 3, to the human acidic α-glucosidase, thereby forming the amino acid sequence set forth as SEQ ID NO: 89.

58. The fusion protein according to 51 above, wherein the protein (A) is human acidic α-glucosidase, wherein the antibody is Fab antibody, and wherein
(1) the light chain of the antibody comprises the amino acid sequence set forth as SEQ ID NO: 23, and
(2) the heavy chain of the antibody comprises the amino acid sequence set forth as SEQ ID NO: 61, and the heavy chain is linked, on the C-terminal side thereof and via the amino acid sequence consisting of three consecutively linked amino acid sequences each set forth as SEQ ID NO: 3, to the human acidic α-glucosidase having the amino acid sequence set forth as SEQ ID NO: 55 or 56.

59. The fusion protein according to 51 above, wherein the protein (A) is human α-L-iduronidase, wherein the antibody is Fab antibody, and wherein
(1) the light chain of the antibody comprises the amino acid sequence set forth as SEQ ID NO: 23, and
(2) the heavy chain of the antibody is linked, on the C-terminal side thereof and via the amino acid sequence consisting of three consecutively linked amino acid sequences each set forth as SEQ ID NO: 3, to the human α-L-iduronidase, thereby forming the amino acid sequence set forth as SEQ ID NO: 93.

60. The fusion protein according to 51 above, wherein the protein (A) is human α-L-iduronidase, wherein the antibody is Fab antibody, and wherein
(1) the light chain of the antibody comprises the amino acid sequence set forth as SEQ ID NO: 23, and
(2) the heavy chain of the antibody comprises the amino acid sequence set forth as SEQ ID NO: 61, and the heavy chain is linked, on the C-terminal side thereof and via the amino acid sequence consisting of three consecutively linked amino acid sequences each set forth as SEQ ID NO: 3, to the human α-L-iduronidase having the amino acid sequence set forth as SEQ ID NO: 75 or 76.

61. The fusion protein according to 41 above, wherein a human IgG Fc region or part thereof is introduced between the protein (A) and the antibody.

62. The fusion protein according to 61 above, wherein the human IgG Fc region is linked, directly or via a linker sequence, to the protein (A) on the C-terminal side thereof, and the heavy chain or the light chain of the antibody is linked, directly or via a linker sequence, to the human IgG Fc region on the C-terminal side thereof.

63. The fusion protein according to 61 or 62 above, wherein the human IgG Fc region comprises the amino acid sequence set forth as SEQ ID NO: 70.

64. The fusion protein according to 63 above, wherein the human IgG Fc region is linked, via a linker sequence, to a Fab heavy chain consisting of the amino acid sequence set forth as SEQ ID NO: 61, and comprises the amino acid sequence set forth as SEQ ID NO: 71 formed thereby.

65. A DNA fragment encoding the amino acid sequence of the anti-human transferrin receptor antibody according to one of 1 to 40 above.

66. A DNA fragment encoding the amino acid sequence of the fusion protein according to one of 41 to 64 above.

67. An expression vector comprising the DNA fragment according to 65 or 66 above that is incorporated therein.

68. A mammalian cell transformed with the expression vector according to 67 above.

69. An anti-human transferrin receptor antibody-pharmacologically active compound complex, wherein the light chain and/or the heavy chain of the anti-human transferrin receptor antibody according to one of 1 to 40 above is linked to a low-molecular-weight pharmacologically active compound that needs to be allowed to pass through the blood-brain barrier and exhibit the function thereof in the brain.

70. The anti-human transferrin receptor antibody-pharmacologically active compound complex according to 69 above, wherein the pharmacologically active compound is any one selected from the group consisting of anticancer drug, therapeutic agent for Alzheimer's disease, therapeutic agent for Parkinson's disease, therapeutic agent for Huntington's disease, therapeutic agent for schizophrenia, antidepressant, therapeutic agent for multiple sclerosis, therapeutic agent for amyotrophic lateral sclerosis, therapeutic agent for tumors of central nervous system including brain tumor, therapeutic agent for lysosomal storage disease accompanied by encephalopathy, therapeutic agent for glycogenosis, therapeutic agent for muscular dystrophy, therapeutic agent for cerebral ischemia, therapeutic agent for prion diseases, therapeutic agent for traumatic central nervous system disorders, therapeutic agent for viral and bacterial central nervous system diseases, pharmaceutical agent used for recovery after brain surgery, pharmaceutical agent used for recovery after spinal surgery, siRNA, antisense DNA, and peptide.

71. Use of the anti-human transferrin receptor antibody according to one of 1 to 40 above for allowing the protein (A) or a low-molecular-weight pharmacologically active compound to pass through the blood-brain barrier and exhibit the function thereof in the brain.

72. Use of the anti-human transferrin receptor antibody according to one of 1 to 40 above for the production of a pharmaceutical agent for parenteral administration for the treatment of a disease condition of the central nervous system, by linking thereto the molecule of a physiologically active protein or a pharmacologically active low-molecular-weight compound for the disease condition.

73. A method for treatment of a disease condition of the central nervous system comprising parenterally administering to a patient with the disorder a therapeutically effective amount of the physiologically active protein, or pharmacologically active low-molecular-weight compound, for the disorder, in the form of a conjugate with the molecule of the anti-human transferrin receptor antibody according to one of 1 to 40 above.

74. Use of the fusion protein according to one of 52 to 58 above for making human acidic α-glucosidase pass through the blood-brain barrier and exhibit the function thereof in the brain.

75. Use of the fusion protein according to one of 52 to 58 above for the production of a pharmaceutical agent for parenteral administration for the treatment of a disease condition of the central nervous system accompanying Pompe's disease.

76. A method for the treatment of a disease of the central nervous system accompanying Pompe's disease comprising parenterally administering a therapeutically effective amount of the fusion protein according to one of 52 to 58 above to a patient with the disease.

77. Use of the fusion protein according to one of 52 to 54, 59, and 60 above for making human acidic α-L-iduronidase pass through the blood-brain barrier and exhibit the function thereof in the brain.

78. Use of the fusion protein according to one of 52 to 54, 59, and 60 above for the production of a pharmaceutical agent for parenteral administration for the treatment of a disease condition of the central nervous system accompanying Hurler syndrome or Hurler-Scheie syndrome.

79. A method for the treatment of a disease of the central nervous system accompanying Hurler syndrome or Hurler-Scheie syndrome, the method comprising parenterally administering a therapeutically effective amount of the fusion protein according to one of 52 to 54, 59, and 60 above to a patient with the disease.

Effects of the Invention

By the present invention, various compounds, such as proteins and low-molecular-weight compounds that, although physiologically or pharmacologically active, have been unusable by parenteral administration because of their no or little ability to pass through the blood-brain barrier, can be provided in the form that allow them to pass through the blood-brain barrier, thus making them new pharmaceutical agents for parenteral administration for the treatment of a disease condition of the central nervous system.

EMBODIMENTS FOR CARRYING OUT THE INVENTION

Figure 1:
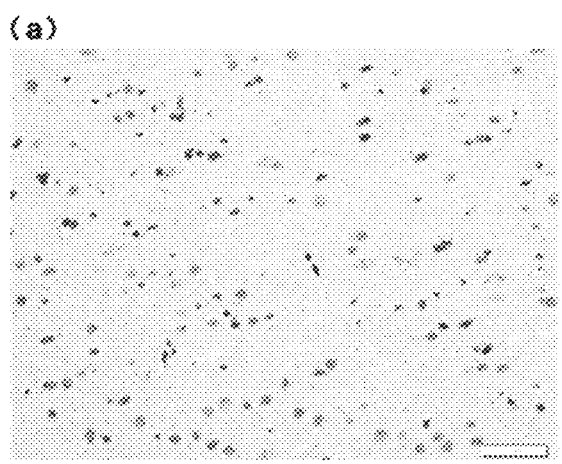
FIG. 1 Substitute photographs for drawings showing the result of the immunohistochemical staining of the anti-hTfR antibody in the cerebral cortex of a crab-eating monkey after a single intravenous administration of the anti-hTfR antibody. (a) anti-hTfR antibody not administered, (b) anti-hTfR antibody No.3 administered. The bar at the bottom right in each photograph is a 50-μm gauge.
Figure 1:
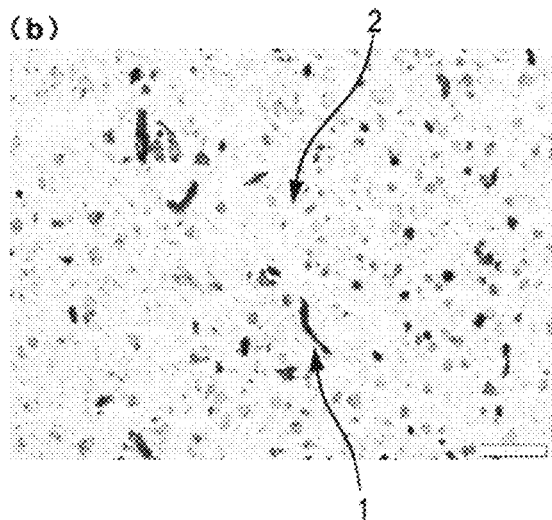

In the present invention, the term "antibody" refers mainly to a human antibody, mouse antibody, humanized antibody, as well as a chimeric antibody between human antibody and non-human mammalian antibody, and a chimeric antibody between mouse antibody and non-mouse mammalian antibody, but the meaning of the term is not limited to them insofar as a substance of interest has a property to specifically bind to a certain antigen, and there is no specific limitation as to the animal species of the antibody, either. However, preferred is a humanized antibody.

In the present invention, the term "human antibody" refers to an antibody whose entire protein is encoded by a gene originating from human. The term "human antibody", however, also includes an antibody encoded by a gene obtained by introducing a mutation into an original human gene for a purpose of enhancing expression efficacy of the gene, for example, without modifying the original amino acid sequence. The term "human antibody" also includes an antibody which is produced by combining two or more genes encoding human antibodies and replacing certain part of a human antibody with part of another human antibody. A human antibody includes three complementarity determining regions (CDRs) in the light chain of the immunoglobulin and three complementarity determining regions (CDRs) in the heavy chain of the immunoglobulin. The three CDRs in the light chain of the immunoglobulin are called, from the N-terminal side, CDR1, CDR2 and CDR3, respectively. The three CDRs in the heavy chain of the immunoglobulin are also called, from the N-terminal side, CDR1, CDR2 and CDR3, respectively. The term "human antibody" also includes a human antibody produced by replacing a CDR of a human antibody with a CDR of another human antibody to modify such properties as the antigen specificity and the affinity of the original human antibodies, etc.

In the present invention, the term "human antibody" also includes an antibody which is produced through modification of the gene of the original human antibody by introducing a mutation, such as substitution, deletion, addition, to the amino acid sequence of the original antibody. When replacing one or more amino acids of the amino acid sequence of the original antibody with other amino acids, the number of amino acid replaced may preferably be 1-20, more preferably 1-5, and still more preferably 1-3. When deleting one or more amino acids of the amino acid sequence of the original antibody, the number of amino acids deleted may preferably be 1-20, more preferably 1-5, and still more preferably 1-3. An antibody produced by a combined mutation of these substitution and deletion of amino acids is also a "human antibody". In some cases, one or more amino acids, preferably 1-20, more preferably 1-5, and still more preferably 1-3 amino acids may be added inside the amino acid sequence of the original antibody or on its N- or C-terminal side. An antibody produced by a combined mutation of addition, substitution, and deletion of amino acids is also a "human antibody". The amino acid sequence of such a mutated antibody has a homology of preferably not lower than 80%, more preferably not lower than 90%, still more preferably not lower than 95%, and even more preferably not lower than 98%, to the amino acid sequence of the original antibody. Thus, in the present invention, the term "gene originating from human" includes not only the unmutated gene originating from human but also a gene produced by modifying this.

The homology between the amino acid sequence of an unmutated antibody and the amino acid sequence of an antibody produced by introducing a mutation into it may be readily calculated using well-known homology calculator algorithms. As such algorithms, there are, for example, BLAST (Altschul S F. J Mol. Biol. 215. 403-10 (1990)), a similarity search by Pearson and Lipman (Proc. Natl. Acad. Sci. USA. 85. 2444 (1988)), and the local homology algorithm of Smith and Waterman (Adv. Appl. Math. 2. 482-9 (1981)), and the like.

In the present invention, the term "mouse antibody" refers to an antibody whose entire protein consists of an amino acid sequence which is the same as an antibody encoded by a gene originating from a mouse. Therefore, the term "mouse antibody" also includes an antibody that is encoded by a gene produced by introducing a mutation into the original mouse gene without causing a change in its amino acid sequence but in order, for example, to improve the expression efficiency of the gene. Further, the term "mouse antibody" also includes an antibody produced through combining two or more genes encoding mouse antibodies by replacing part of a mouse antibody with part of another mouse antibody. A mouse antibody has three complementarity determining regions (CDRs) in the light chain of the immunoglobulin and three complementarity determining regions (CDRs) in the heavy chain of the immunoglobulin. The three CDRs in the light chain of the immunoglobulin are called, from the N-terminal side, CDR1, CDR2 and CDR3, respectively. The three CDRs in the heavy chain of the immunoglobulin are also called, from the N-terminal side, CDR1, CDR2 and CDR3, respectively. The term "mouse antibody" also includes an antibody produced by replacing a CDR of a mouse antibody with a CDR of another mouse antibody to modify the specificity and affinity of the original mouse antibodies.

In the present invention, the term "mouse antibody" also includes an antibody which is produced through modification of the gene of the original mouse antibody by introducing a mutation, such as substitution, deletion, addition, to the amino acid sequence of the original antibody. When replacing one or more amino acids of the amino acid sequence of the original antibody with other amino acids, the number of amino acid replaced may preferably be 1-20, more preferably 1-5, and still more preferably 1-3. When deleting one or more amino acids of the amino acid sequence of the original antibody, the number of amino acids deleted may preferably be 1-20, more preferably 1-5, and still more preferably 1-3. An antibody produced by a combined mutation of these substitution and deletion of amino acids is also included in a "mouse antibody". When adding one or more amino acids, they may be added inside the amino acid sequence of the original antibody or on its N- or C-terminal side, preferably 1-20, more preferably 1-5, and still more preferably 1-3, in number. An antibody produced by a combined mutation of addition, substitution, and deletion of amino acids is also included in a "mouse antibody". The amino acid sequence of such a mutated antibody has a homology of preferably not lower than 80%, more preferably not lower than 90%, still more preferably not lower than 95%, and even more preferably not lower than 98%, to the amino acid sequence of the original antibody. Thus, in the present invention, the term "gene originating from mouse" includes not only the unmutated gene originating from mouse but also a gene produced by modifying this.

In the present invention, the term "humanized antibody" refers to an antibody in which part of the amino acid sequence of its variable region (e.g., especially the whole or part of its CDRs) originates from a non-human mammal while the rest originates from human. An example of humanized antibody is an antibody produced by replacing the three complementarity determining regions (CDRs) of the light chain of the immunoglobulin and the three complementarity determining regions (CDRs) of the heavy chain of the immunoglobulin constituting a human antibody, with CDRs from a non-human mammal. As far as it originates from a non-human mammal, there is no particular limitation as to the biological species from which those CDRs originate that are transplanted into a proper position of the human antibody, though preferred are mouse, rat, rabbit, horse or non-human primate, more preferred are mouse and rat, and still more preferred is mouse.

In the present invention, the term "chimeric antibody" refers to an antibody produced by connecting fragments of two or more different antibodies originating from two or more different species.

A chimeric antibody between a human antibody and a non-human mammalian antibody is an antibody provided by replacing part of a human antibody with part of a non-human mammalian antibody. As explained below, an antibody is made of an Fc region, a Fab region and a hinge region. A specific example of such chimeric antibodies is a chimeric antibody whose Fc region originates from a human antibody while its Fab region originates from a non-human mammalian antibody. The hinge region either originates from a human antibody or from a non-human mammalian antibody. On the contrary, the term chimeric antibody also includes one whose Fc region originates from a non-human mammalian antibody while its Fab region originates from a human antibody. In such a case also, the hinge region either originates from a human antibody or from a non-human mammalian antibody.

An antibody can be viewed as composed of a variable region and a constant region. Additional examples of chimeric antibodies include an antibody in which the heavy chain constant region ($C_H$) and the light chain constant region ($C_l$) both originate from a human antibody while the heavy chain variable region ($V_H$) and the light chain variable region ($V_L$) both originate from an antibody of a non-human mammal, and conversely, an antibody in which the heavy chain constant region ($C_H$) and the light chain constant region ($C_l$) both originate from an antibody of a non-human mammal, while the heavy chain variable region ($V_H$) and the light chain variable region ($V_L$) both originate from a human antibody. In these, there is no particular limitation as to the biological species of the non-human mammal, as far as it is a non-human mammal, though preferred are mouse, rat, rabbit, horse or non-human primate, and more preferred is mouse.

A chimeric antibody between a mouse antibody and a non-mouse mammalian antibody is an antibody provided by replacing part of a mouse antibody with part of a non-mouse mammalian antibody. Specific examples of such chimeric antibodies include a chimeric antibody whose Fc region originates from a mouse antibody while its Fab region originates from a non-mouse mammalian antibody, and conversely, a chimeric antibody whose Fc region originates from a non-mouse mammal while its Fab region originates from a mouse antibody. In these, there is no particular limitation as to the biological species of the non-mouse mammal, as far as it is a mammal other than mouse, though preferred are rat, rabbit, horse or non-human primate, and more preferred is human.

A chimeric antibody between a human antibody and a mouse antibody is designated in particular "human/mouse chimeric antibody". Examples of human/mouse chimeric antibodies include a chimeric antibody in which the Fc region originates from a human antibody while the Fab region originates from a mouse antibody, and conversely, a chimeric antibody whose Fc region originates from mouse antibody, while its Fab region originates from a human antibody. A hinge region either originates from a human antibody or a mouse antibody. Additional specific examples of human/mouse chimeric antibodies include those whose heavy chain constant region ($C_H$) and light chain constant region ($C_L$) originate from a human antibody while its heavy chain variable region ($V_H$) and light chain variable region ($V_L$) originate from a mouse antibody, and conversely, those whose heavy chain constant region ($C_H$) and light chain constant region ($C_L$) originate from a mouse antibody while its heavy chain variable region ($V_H$) and light chain variable region ($V_L$) originate from a human antibody.

Originally, an antibody is of the basic structure having four polypeptide chains in total consisting of two immunoglobulin light chains and two immunoglobulin heavy chains. However, in the present invention the term "antibody" refers, besides an antibody having this basic structure, also to:

(1) one consisting of two polypeptide chains: a single immunoglobulin light chain and a single immunoglobulin heavy chain, and also, as explained later, (2) a single-chain antibody consisting of an immunoglobulin light chain which is linked, on the C-terminal side thereof, to a linker sequence which in turn is linked, on the C-terminal side thereof, to an immunoglobulin heavy chain, (3) single-chain antibodies consisting of an immunoglobulin heavy chain which is linked, on the C-terminal side thereof, to a linker sequence which in turn is linked, on the C-terminal side thereof, to an immunoglobulin light chain, and (4) one consisting of a Fab region, i.e., a structure left behind by removal of the Fc region from an antibody having the basic structure, as the original meaning, and one consisting of the Fab region and the whole or part of the hinge region (including Fab, F(ab'), and F(ab')$_2$) also are included in the term "antibody" in the present invention.

The term "Fab" refers to a molecule consisting of a single light chain comprising the variable region and the $C_L$ region (light chain constant region) and a single heavy chain comprising the variable region and the $C_H1$ region (portion 1 of heavy chain constant region) which are combined by a disulfide bond between their respective cysteine residues. While the heavy chain in a Fab can include part of the hinge region in addition to the variable region and the $C_H1$ region (portion 1 of heavy chain constant region), the hinge region in such a case lacks the cysteine residue that otherwise is present in the hinge region and would serve to link two heavy chains of an antibody together. In Fab, the light chain and the heavy chain are connected by a disulfide bond formed between the cysteine residue present in the light chain constant region ($C_L$ region) and the cysteine residue located in the heavy chain constant region ($C_H1$ region) or the hinge region. The heavy chain forming Fab is called a Fab heavy chain. As it lacks the cysteine residue in the hinge region which serves to bind two heavy chains of an antibody, Fab consists of a single light chain and a single heavy chain. The light chain constituting Fab includes a variable region and a $C_L$ region. The heavy chain as a component of Fab may either consist of a variable region and a $C_H1$ region or also of part of the hinge region in addition to the variable region and the $C_H1$ region. However, in the letter case, the hinge region is so selected as not to include the cysteine residue that could bind two heavy chains, in order to avoid the formation of a disulfide bond between two heavy chains at their hinge regions. In F(ab'), the heavy chain includes, in addition to a variable region and a $C_H1$ region, the whole or part of a hinge region containing a cysteine residue that could bind two heavy chains. F(ab')$_2$ is a molecule consisting of two F(ab')s bound together through a disulfide bond formed between the cysteine residues present in their respective hinge regions. The heavy chain forming F(ab') or F(ab')$_2$ is called a Fab' heavy chain. Further, a polymer such as a dimer and a trimer, which consists of two or more antibodies connected with each other, directly or via a linker, is also included in the term "antibody". Moreover, in addition to the aforementioned, any molecule that includes part of an immunoglobulin molecule and has a property to specifically bind to the antigen is also included in the term "antibody" in the present invention. Thus, in the present invention, the term "immunoglobulin light chain" includes a molecule that is derived from an original immunoglobulin light chain and having the amino acid sequence of the whole or part of its variable region. Likewise, the term "immunoglobulin heavy chain" includes a molecule that is derived from an original immunoglobulin heavy chain and having the amino acid sequence of the whole or part of its variable region. Therefore, insofar as having the whole or part of the amino acid sequence of the variable region, a molecule is included in the term "immunoglobulin heavy chain", even if it lacks its Fc region, for example.

In the above, the term "Fc" or "Fc region" refers to a region comprising a fragment consisting of $C_H2$ region (portion 2 of the heavy chain constant region), and $C_H3$ region (portion 3 of the heavy chain constant region) in the antibody molecule.

Furthermore, in the present invention, the term "antibody" also includes:

(5) scFab, scF(ab'), and scF(ab')$_2$, which are single-chain antibodies produced by binding the light chain to the heavy chain that form, respectively, the Fab, F(ab') and F(ab')$_2$ mentioned in (4) above, via a linker sequence. Such scFab, scF(ab') and scF(ab')$_2$ may be a molecule in which either the light chain is linked, on the C-terminal side thereof, to a linker sequence, which in turn is linked, on the C-terminal side thereof, to the heavy chain, or the heavy chain is linked, on the C-terminal side thereof, to a linker sequence, which in turn is linked, on the C-terminal side thereof, to the light chain. Furthermore, a scFv, which is a single-chain antibody provided by binding the light chain variable region to the heavy chain variable region, via a linker sequence between them, is also included in the term "antibody" in the present invention. Such scFv may be a molecule in which either the light chain variable region is linked, on the C-terminal side thereof, to a linker sequence, which in turn is linked, on the C-terminal side thereof, to the heavy chain variable region, or the heavy chain variable region is linked, on the C-terminal side thereof, to a linker sequence, which in turn is linked, on the C-terminal side thereof, to the light chain variable region.

Furthermore, in addition to a full-length antibody and those described in (1) to (5) above, the term "antibody" in the present specification includes, any form of antigen-binding fragment which lacks part of the full-length antibody (antibody fragment), a broader concept which includes (4) and (5) above.

The term "antigen-binding fragment" refers to an antibody fragment that retains at least part of the specific binding activity to its antigen. In addition to those described above in (4) and (5), examples of binding fragments include Fab, Fab', F(ab')$_2$, variable region (Fv); a single-chain antibody (scFv) produced by linking the heavy chain variable region (V$_H$) and the light chain variable region (V$_L$), via a proper linker between them; a diabody, which is a dimer of a polypeptide that comprises a heavy chain variable region (V$_H$) and a light chain variable region (V$_L$); a minibody, which is a dimer of a molecule in which the heavy chain (H chain) of a scFv is linked to part of the constant region (C$_H$3), and other low-molecular-antibodies. However, as far as it has an antigen-binding ability, the term is not limited to these molecules. Such binding fragments include not only those produced by treating a full-length molecule of an antibody protein with a proper enzyme but also those produced by proper host cells using a genetically engineered antibody gene.

In the present invention, the term "single-chain antibody" refers to a protein in which an amino acid sequence comprising the whole or part of an immunoglobulin light chain variable region linked, on the C-terminal side thereof, to a linker sequence, which in turn is linked, on the C-terminal side thereof, to the amino acid sequence of the whole or part of an immunoglobulin heavy chain variable region, and having an ability to specifically bind a certain antigen. For example, those described in (2), (3) and (5) are included in "single-chain antibody". Further, a protein in which an amino acid sequence comprising the whole or part of an immunoglobulin heavy chain variable region is linked, on the C-terminal side thereof, to a linker sequence, which in turn is further linked, on the C-terminal side thereof, to the amino acid sequence of the whole or part of an immunoglobulin light chain variable region, and which has an ability to specifically bind to a certain antigen, is also included in the term "single-chain antibody" in the present invention. In a single-chain antibody in which an immunoglobulin heavy chain is linked, on the C-terminal side thereof and via a linker sequence, to an immunoglobulin light chain, the immunoglobulin heavy chain generally lacks the Fc region. An immunoglobulin light chain variable region has three complementarity determining regions (CDRs) which participate in determining the antigen specificity of an antibody. Likewise, an immunoglobulin heavy chain variable region also has three CDRs. Those CDRs are the primary regions that determine the antigen specificity of an antibody. Therefore, a single-chain antibody preferably contains all the three CDRs of the immunoglobulin heavy chain and all the three CDRs of the immunoglobulin light chain. However, it is also possible to provide a single-chain antibody in which one or more of those CDRs are deleted, insofar as the antigen-specific affinity of the antibody is retained.

In a single-chain antibody, the linker sequence placed between the light chain and the heavy chain of the immunoglobulin is preferably a peptide chain consisting of preferably 2 to 50, more preferably 8 to 50, still more preferably 10 to 30, even more preferably 12 to 18, or 15 to 25, for example 15 or 25 amino acid residues. While there is no particular limitation as to the specific amino acid sequence of such a linker sequence insofar as the anti-hTfR antibody comprising the both chains linked thereby retains the affinity to hTfR, it is preferably made of glycine only, or of glycine and serine: for example the amino acid sequence Gly-Ser, the amino acid sequence Gly-Gly-Ser, the amino acid sequence Gly-Gly-Gly, the amino acid sequence Gly-Gly-Gly-Gly-Ser (SEQ ID NO:3), the amino acid sequence Gly-Gly-Gly-Gly-Gly-Ser (SEQ ID NO:4), the amino acid sequence Ser-Gly-Gly-Gly-Gly (SEQ ID NO:5), or a sequence which includes 2 to 10 or 2 to 5 repeats of any of those amino acid sequences. For example, in linking the amino acid sequence of the entire immunoglobulin heavy chain variable region, on the C-terminal side thereof and via a linker sequence, to immunoglobulin light chain variable region, the linker sequence is preferably a linker sequence comprising 15 amino acids corresponding to three of the amino acid sequence Gly-Gly-Gly-Gly-Ser (SEQ ID NO:3) consecutively linked.

In the present invention, the term "human transferrin receptor" or "hTfR" refers to a membrane protein having the amino acid sequence set forth as SEQ ID NO:1. The anti-hTfR antibody of the present invention is, in one of its embodiments, that which specifically binds to the amino acid sequence set forth as SEQ ID NO:1 in its part starting with the cysteine residue at position 89 from the N-terminal side to the phenylalanine at the C-terminus (i.e., the extracellular region of the hTfR), though it is not limited to this embodiment. Further, in the present invention, the term "monkey transferrin receptor" or "monkey TfR" refers in particular to the membrane protein having the amino acid sequence set forth as SEQ ID NO:2, originating from crab-eating monkey (*Macaca fascicularis*). The anti-hTfR antibody of the present invention is, in one of its embodiments, that which binds also to the amino acid sequence set forth as SEQ ID NO:2 in its part starting with the cysteine residue at position 89 from the N-terminal side to the phenylalanine at the C-terminus (i.e., the extracellular region of the monkey TfR), though it is not limited to this embodiment.

For preparation of an antibody to hTfR, there is known a general method according to which a recombinant human transferrin receptor (rhTfR) is produced using cells which have an introduced expression vector having an incorporated hTfR gene, and then animals such as mice are immunized with this rhTfR. By collecting those cells which produce antibodies to hTfR from the immunized animals and fusing them with myeloma cells, hybridoma cells can be obtained having an ability to produce the anti-hTfR antibody.

Further, cells producing an antibody to hTfR can also be obtained by collecting immunocompetent cells from an animal such as mouse, and immunizing them with rhTfR by in vitro immunization. In conducting in vitro immunization, there is no particular limitation as to the animal species from which the immunocompetent cells are derived, though preferred are mouse, rat, rabbit, guinea pig, dog, cat, horse, and primates including human, and more preferred are mouse, rat and human, and still more preferably mouse and human. As mouse immunocompetent cells, spleen cells prepared from mouse spleen may be used, for example. As human immunocompetent cells, such cells can be used as prepared from human peripheral blood, bone marrow, spleen, and the like. By immunizing human immunocompetent cells according to in vitro immunization, a human antibody to hTfR can be obtained.

After immunizing the immunocompetent cells according to in vitro immunization, the cells can be fused with myeloma cells to prepare hybridoma cells having an ability to produce the antibody. Further, it is also possible to extract mRNAs from the immunized cells, synthesize cDNA, perform PCR reaction using the cDNA as a template to amplify a DNA fragment containing the gene encoding the light chain and the heavy chain of the immunoglobulin, and artificially reconstruct the antibody gene using them.

The hybridoma cells freshly obtained above also include such cells that produce antibodies that recognize other proteins than hTfR. Furthermore, not all the hybridoma cells producing an anti-hTfR antibody necessarily produce an anti-hTfR antibody that exhibits high affinities to hTfR.

Likewise, artificially reconstructed antibody genes include such genes as encode antibodies recognizing other proteins than hTfR as antigens. Moreover, not all the genes encoding anti-hTfR antibodies necessarily have desired properties such as encoding an anti-hTfR antibody exhibiting high affinity to hTfR.

Therefore, a selection step is necessary to select hybridoma cells producing an antibody having desired properties (such as high affinity to hTfR) from the hybridoma cells freshly obtained above. Further, in the case where antibody genes are artificially reconstructed, a selection step is necessary to select from the antibody genes a gene encoding an antibody having desired properties (such as high affinities to hTfR). For selecting hybridoma cells that produce antibodies exhibiting high affinities to hTfR (high affinity antibodies), or for selecting genes encoding high affinity antibodies, following methods explained in detail below are effective. Besides, antibodies exhibiting high affinity to hTfR are those whose dissociation constant ($K_D$) with hTfR as measured by the method described in Example 7 is preferably not greater than $1 \times 10^{-8}$ M, more preferably not greater than $1 \times 10^{-9}$ M, still more preferably not greater than $1 \times 10^{-10}$ M, and even more preferably not greater than $1 \times 10^{-11}$ M. For example, those having a dissociation constant of $1 \times 10^{-13}$ M to $1 \times 10^{-9}$ M, or $1 \times 10^{-13}$ M to $1 \times 10^{-10}$ M are preferable.

For example, for selecting hybridoma cells which produce high affinity antibodies to anti-hTfR antibody, a method is employed in which recombinant hTfR is added to a plate and held by it, then the culture supernatant of the hybridoma cells is added, and after removing antibody unbound to the recombinant hTfR from the plate, the amount of the antibody held by the plate is measured. According to this method, the higher the affinity to hTfR of the antibody contained in the culture supernatant of the hybridoma cells added to the plate is, the greater the amount of antibody held by the plate becomes. Therefore, by measuring the amount of the antibody held by the plate, it is possible to select those hybridoma cells corresponding to the plates where the antibody is held in the greater amount as cell lines producing an anti-hTfR antibody having the relatively higher affinity to hTfR. It is also possible to isolate the gene encoding the high-affinity antibody by extracting mRNAs from each cell line selected in this manner, synthesizing cDNAs, and amplifying a DNA fragment containing the gene encoding the anti-hTfR antibody by PCR using the cDNA as a template.

In order to select the gene encoding the high-affinity anti-hTfR antibody from the above artificially reconstructed antibody genes, the artificially reconstructed antibody genes are once incorporated into an expression vector, and the expression vector then is introduced into host cells. Although there is no particular limitation as to the cells to be employed as host cells, even whether they are prokaryotic eukaryotic, insofar as they can express the antibody gene after introduction of an expression vector having the incorporated artificially reconstructed antibody gene, preferred are cells originating mammals such as human, mouse, Chinese hamster, and the like, and particularly preferred are CHO cells originating from Chinese hamster ovary cells, or NS/0 cells originating from mouse myeloma. Further, there is no particular limitation as to an expression vector to be employed for incorporation of the antibody encoding gene and expression of it, and any expression vector may be used as far as it can express the gene when incorporated into mammalian cells. The gene incorporated into an expression vector is located downstream of a DNA sequence that can regulate the frequency of transcription of a gene in mammalian cells (gene expression regulatory site). Examples of gene expression regulatory sites that may be employed in the present invention include cytomegalovirus-derived promoter, SV40 early promoter, human elongation factor-1α (EF-1α) promoter, human ubiquitin C promoter.

Mammalian cells having such an introduced expression vector come to express the artificially reconstructed antibody incorporated in the expression vector. In order to select those cells which produce a high-affinity antibody to anti-hTfR antibody from the above obtained cells expressing the artificially reconstructed antibody, a method is employed in which the recombinant hTfR is added to a plate and held by it, then the recombinant hTfR is contacted by the culture supernatant of the cells, and after the removal of antibody unbound to the recombinant hTfR from the plate, the amount of the antibody held by the plate is measured. According to this method, the higher the affinity to hTfR of the antibody contained in the cells culture supernatant is, the greater the amount of antibody held by the plate becomes. Therefore, by measuring the amount of the antibody held by the plate, one can select those cells corresponding to the plate where the antibody is held in the greater amount, as a cell line producing an anti-hTfR antibody having relatively the high-affinity anti-hTfR antibody, and eventually can select a gene encoding an anti-hTfR antibody having a high-affinity anti-hTfR antibody to hTfR. Using cell line selected in this manner, one can perform PCR to amplify a DNA fragment containing the gene encoding the anti-hTfR antibody to isolate the gene encoding the high-affinity antibody.

Selection of the gene encoding a high affinity anti-hTfR antibody from the above artificially reconstructed antibody genes can also be carried out by incorporating the artificially reconstructed antibody genes into an expression vector, introducing the expression vector into *E. coli* cells, culturing the *E. coli* cells, and selecting the *E. coli* cells having the desired gene, in the same manner as in the above selection of hybridoma cells, using the culture supernatant of the *E. coli* cells or an antibody-containing solution prepared by lysing the *E. coli* cells. *E. coli* cells thus selected express the gene encoding an anti-hTfR antibody having a relatively high affinity to hTfR. From this cell line, the gene encoding the anti-hTfR antibody having a relatively the high-affinity anti-hTfR antibody to hTfR can be selected. In order to allow the antibody to be secreted into the *E. coli* culture supernatant, the antibody gene may be incorporated into the expression vector so that a secretion signal sequence is attached on the N-terminal side of the gene.

Another method for selection of the gene encoding a high-affinity anti-hTfR antibody is a method in which the antibody encoded by the above artificially reconstructed antibody gene is expressed and retained on phage particles. For this, the antibody gene is reconstructed as a gene encoding a single-chain antibody. A method for retaining phage particles to retain an antibody on their surface is disclosed in international publications WO1997/09436 and WO1995/11317, and the like, and thus well known. In order to select phages retaining the high-affinity antibody to anti-hTfR antibody from the phages retaining the antibodies encoded by the artificially reconstructed antibody genes, a method is employed in which a recombinant hTfR from the plate is added to a plate and held by, contacted by the phages, and after removal of the phages unbound to the recombinant hTfR, the amount of the phages held by the plate is measured. According to this method, the higher the affinity to hTfR of the antibody retained on the phage particles is, the greater the amount of the phage held by the plate becomes. Therefore, by measuring the amount of the phage held by the plate, one can select the phage particles corresponding to the plate where the phages' were held in the greater amount, as the phage particles producing anti-hTfR antibody having a relatively the high-affinity anti-hTfR antibody to hTfR, and eventually can select the gene encoding the high-affinity anti-hTfR antibody to hTfR. Using the phage particles thus selected, PCR can be performed to amplify a DNA fragment containing the gene encoding the anti-hTfR antibody and isolate the gene encoding the high-affinity antibody.

It is possible to prepare cDNA or phage DNA from the above cells such as the hybridoma cells producing the high-affinity antibody to anti-hTfR, or from the above phage particles retaining high-affinity antibody to anti-hTfR, and perform PCR or the like using it as a template to amplify and isolate a DNA fragment containing the gene encoding the whole or part of the anti-hTfR antibody light chain, the anti-hTfR antibody heavy chain, or a single-chain antibody, as an anti-hTfR antibody. In the same manner, it is also possible to perform PCR or the like to amplify and isolate a DNA fragment containing the gene encoding the whole or part of the light chain variable region of the anti-hTfR antibody, or a DNA fragment containing the gene encoding the whole or part of the heavy chain variable region of the anti-hTfR antibody.

A high-affinity anti-hTfR antibody can be obtained by incorporating the whole or part of the gene encoding the light chain and the heavy chain of this high-affinity anti-hTfR antibody into an expression vector, transforming host cells such as mammalian cells with this expression vector, and culturing the obtained transformant cells. Using the nucleotide sequence of the isolated gene encoding the anti-hTfR antibody, it is also possible to translate the amino acid sequence of the anti-hTfR antibody, and artificially synthesize a DNA fragment encoding the same amino acid sequence. In artificially synthesizing a DNA fragment, the expression level of the anti-hTfR antibody in the host cells can be enhanced by proper selection of the codons.

In order to introduce a mutation such as substitution, deletion, addition and the like into the amino acid sequence of the original anti-hTfR antibody, a mutation may be introduced as desired into the gene encoding the anti-hTfR antibody contained in the isolated DNA fragment. Though the gene encoding the mutated anti-hTfR antibody has a homology preferably not lower than 80%, more preferably not lower than 90%, to the original gene, there is no particular limitation as to the level of homology. By introducing a mutation into the amino acid sequence so as to modify the number or the type of sugar chains bound to the anti-hTfR antibody, it is also possible to enhance the stability of the anti-hTfR antibody in the body.

When introducing a mutation into the gene encoding the whole or part of the light chain variable region of the anti-hTfR antibody, the gene thus mutated has a homology that is preferably not lower than 80%, more preferably not lower than 90%, to the original gene, though there is no particular limitation as to the level of homology. When replacing one or more amino acids of the amino acid sequence of the light chain variable region with other amino acids, the number of amino acids to be replaced is preferably 1 to 10, more preferably 1 to 5, still more preferably 1 to 3, and even more preferably 1 or 2. When deleting one or more amino acids of the amino acid sequence of the light chain variable region, the number of amino acid to be deleted is preferably 1 to 10, more preferably 1 to 5, still more preferably 1 to 3, even more preferably 1 or 2. A combined mutation of these substitution and deletion of amino acids can also be carried out. When adding one or more amino acids to the light chain variable region, they may be added inside, or on the N-terminal side or C-terminal side of, the amino acid sequence of the light chain variable region, and the number of amino acids added is preferably 1 to 10, more preferably 1 to 5, still more preferably 1 to 3, and even more preferably 1 or 2. A combined mutation of these addition, substitution, and deletion of amino acids can also be carried out. The amino acid sequence of the light chain variable region thus mutated has a homology that is preferably not lower than 80%, more preferably not lower than 90%, still more preferably not lower than 95% to the amino acid sequence of the original light chain variable region. In particular, when replacing one or more amino acids of the amino acid sequence of CDR with other amino acids, the number of amino acid replaced is preferably 1 to 5, more preferable 1 to 3, still more preferably 1 or 2. When deleting one or more amino acid of the amino acid sequence of CDR, the number of amino acids to be deleted is preferably 1 to 5, more preferably 1 to 3, still more preferably 1 or 2. A combined mutation of these substitution and deletion of the amino acid can also be carried out. When adding one or more amino acids, they may be added inside, or on the N-terminal side or C-terminal side of, the amino acid sequence, and the number of amino acids added is preferably 1 to 5, more preferably 1 to 3, still more preferably 1 or 2. A combined mutation of these addition, substitution, and deletion of amino acids can also be carried out. The amino acid sequence of respective mutated CDR has a homology that is preferably not lower than 80%, more preferably not lower than 90%, and still more preferably not lower than 95% to the amino acid sequence of the original CDR.

When introducing mutation into the gene encoding the whole or part of the heavy chain variable region of the anti-hTfR antibody, the gene thus mutated has a homology that is preferably not lower than 80%, more preferably not lower than 90%, to the original gene, though there is no particular limitation as to the level of homology. When replacing one or more amino acids of the amino acid sequence of the heavy chain variable region with other amino acids, the number of amino acids to be replaced is preferably 1 to 10, more preferably 1 to 5, still more preferably 1 to 3, and even more preferably 1 or 2. When deleting one or more amino acids of the amino acid sequence of the heavy chain variable region, the number of amino acids to be deleted is preferably 1 to 10, more preferably 1 to 5, still more preferably 1 to 3, even more preferably 1 or 2. A combined mutation of these substitution and deletion of amino acids can also be carried out. When adding one or more amino acid to the heavy chain variable region, they may be added inside, or on the N-terminal side or C-terminal side of, the amino acid sequence of the heavy chain variable region, and the number of amino acids added is preferably 1 to 10, more preferably 1 to 5, still more preferably 1 to 3, and even more preferably 1 or 2. A combined mutation of these addition, substitution, and deletion of amino acids can also be carried out. The amino acid sequence of the heavy chain variable region thus mutated has a homology that is preferably not lower than 80%, more preferably not lower than 90%, still more preferably not lower than 95% to the amino acid sequence of the original heavy chain variable region. In particular, when replacing one or more amino acids of the amino acid sequence of CDR with other amino acids, the number of amino acid replaced is preferably 1 to 5, more preferable 1 to 3, still more preferably 1 or 2. When deleting one or more amino acid of the amino acid sequence of CDR, the number of amino acids to be deleted is preferably 1 to 5, more preferably 1 to 3, still more preferably 1 or 2. A combined mutation of these substitution and deletion of the amino acid can also be carried out. When adding one or more amino acids, they may be added inside, or on the N-terminal side or C-terminal side of, the amino acid sequence, and the number of amino acids added is preferably 1 to 5, more preferably 1 to 3, still more preferably 1 or 2. A combined mutation of these addition, substitution, and deletion of amino acids can also be carried out. The amino acid sequence of respective mutated CDR has a homology that is preferably not lower than 80%, more preferably not lower than 90%, and still more preferably not lower than 95% to the amino acid sequence of the original CDR.

A mutation may be introduced into both the variable regions of the light chain and the heavy chain of the anti-hTfR antibody, by combining the above mutation into the light chain variable region of the anti-hTfR antibody and the above mutation into the heavy chain variable region of the anti-hTfR antibody.

Examples of the above mentioned substitution of one or more amino acids in the amino acid sequence of the light chain and the heavy chain of the anti-hTfR antibody include amino acids classified into the same groups, such as aromatic amino acids (Phe, Trp, Tyr), aliphatic amino acids (Ala, Leu, Ile, Val), polar amino acids (Gln, Asn), basic amino acids (Lys, Arg, His), acidic amino acids (Glu, Asp), amino acids having a hydroxy group (Ser, Thr). It is expected that the substitution between such analogous amino acids does not bring about any change to the phenotype of the protein (i.e., it is conservative amino acid substitution). However, the amino acid sequence of the framework region 3 (SEQ ID NO: 83) of hTfR of antibody No. 3 (not published at the point of filing of the present application) previously found by the present inventor and confirmed to have the same type of effect as in the present application has Trp at position 17 thereof. By contrast, the heavy chain framework region 3 of anti-hTfR antibody No. 3N of the present invention has the amino acid sequence set forth as SEQ ID NO: 68 in which the position 17 from the N-terminal side thereof is substituted by Leu. Further, in the amino acid sequence of CDR1, Thr at position 5 of SEQ ID NO: 12 is substituted by Met, as shown in SEQ ID NO: 66. Trp and Leu do not have the above mentioned analogous relationship, and Thr and Met do not have the above mentioned analogous relationship. Nonetheless, as mentioned later, antibody No. 3N containing the substitution has, unexpectedly, the same type of effect as that of antibody No. 3 and exhibits superior effects.

Besides, in the case where a mutation is introduced into the anti-hTfR antibody by adding one or more amino acids to the C-terminus or the N-terminus, if the anti-hTfR antibody and a different protein (A) are fused placing the added amino acids between them, the added amino acids constitutes part of a linker. A detailed explanation will be given later on a linker that is placed between the anti-hTfR antibody and a protein (A) in the fusion protein of the anti-hTfR antibody and the protein (A).

The anti-hTfR antibody obtained by culturing the cells selected by the above methods and the like, as producing an anti-hTfR antibody that has a relatively the high-affinity anti-hTfR antibody to hTfR, and the anti-hTfR antibody obtained by expression of the gene encoding a high-affinity anti-hTfR antibody, may be modified by introducing a mutation into their amino acid sequences, such as substitution, deletion, addition to give them desired properties. Introduction of a mutation into the amino acid sequence of the anti-hTfR antibody may be performed by introducing a mutation into the gene corresponding to the amino acid sequence.

The affinity of an anti-hTfR antibody to hTfR can be adjusted as desired by introduction of a mutation, such as substitution, deletion, and addition, into the amino acid sequence of a variable region of the antibody. For example, if an antibody has such a high affinity to its antigen that leads to too low a dissociation constant in water, there is a possibility that the antibody could, after administered to the body, fail to dissociate from the antigen, thereby leading to a functional disadvantage. In such a case, a most preferable antibody suitable to a given purpose can be obtained by introducing a mutation into the variable region of the antibody so as to adjust its dissociation constant stepwise to 2 to 5 times, 5 to 10 times, 10 to 100 times, and so on, that of the original antibody. Conversely, the dissociation constant can be adjusted stepwise to $\frac{1}{2}$ to $\frac{1}{5}$ times, $\frac{1}{5}$ to $\frac{1}{10}$ times, $\frac{1}{10}$ to $\frac{1}{100}$ times, and so on, that of the original antibody, by introducing a mutation.

Introduction of a mutation such as substitution, deletion and addition to the amino acid sequence of the anti-hTfR antibody can be performed by introducing a mutation into certain positions of the nucleotide sequence of the gene either, for example, by PCR or the like using the gene encoding the anti-hTfR antibody as a template, or by random introduction of a mutation.

Introduction of a mutation into the amino acid sequence of the anti-hTfR antibody for adjusting the affinity of the antibody to hTfR can be carried out by, for example, incorporating a gene encoding the anti-hTfR antibody as a single-chain antibody into a phagemid, preparing with this phagemid a phage with expressed single-chain antibody on the surface of its capsid, letting the phage multiply while introducing a mutation into the gene encoding the single-chain antibody by application of a mutagen or the like, and selecting, from the multiplied phage, a phage expressing a single-chain antibody having a desired dissociation constant either by the method described above or by purification using an antigen column under a certain condition.

The antibodies having a relatively high-affinity to hTfR obtained by the above-mentioned method of selecting the cells producing a high affinity antibody, are those whose dissociation constant ($K_D$) with hTfR as measured by the method described in Example 7 is preferably not greater than $1 \times 10^{-8}$ M, more preferably not greater than $1 \times 10^{-9}$ M, still more preferably not greater than $1 \times 10^{-10}$ M, and even more preferably not greater than $1 \times 10^{-11}$ M. For example, those having a dissociation constant of $1 \times 10^{-13}$ M to $1 \times 10^{-9}$ M, or $1\times10^{-13}$ M to $1\times10^{-10}$ M are preferable. The same also applies if the antibodies are single-chain antibodies. Once an antibody is obtained, it can be modified as desired by, e.g., introducing a mutation to give it a desired property.

Antibody having affinity both to human and monkey TfRs can be obtained by selection of antibodies having affinity to monkey TfR from the anti-hTfR antibody that have been obtained as described above. Selection of antibodies having affinity to monkey TfR can be carried out by, for example, ELISA using a recombinant monkey TfR which is prepared utilizing recombinant DNA technologies. In such an ELIZA, a recombinant monkey TfR is added to a plate and held by it, and contacted by the anti-hTfR antibody, and, after removal of antibody unbound to the recombinant monkey TfR from the plate, the amount of the antibody held by the plate is measured. The higher the affinity of it to the recombinant monkey hTfR is, the greater the amount of the antibody held by the plate becomes, and therefore. Consequently, the antibody corresponding to the plate which held the greater amount of antibody can be selected as the antibody having affinity to monkey TfR. Here, the term "monkey" is preferably classified as simians except human, more preferably as Cercopithecidae, still more preferably as macaques, and for example crab-eating monkey or Rhesus monkey, among which crab-eating monkey is convenient for use in examination.

An antibody having affinity both to human and monkey hTfRs offers an advantage that it allows pharmacokinetic observation of the antibody administered to the body using a monkey. For example, if a medical drug is being developed utilizing such an anti-hTfR antibody of the present invention, the progress of its development can be remarkably accelerated, for its pharmacokinetic study can be performed using a monkey.

In the present invention, an antibody having a relatively high affinity to hTfR and also having affinity to monkey TfR exhibits a dissociation constant with human and monkey TfRs as follows, in particular, as measured by the method described in Example 7:

(a) dissociation constant with hTfR: preferably not greater than $1\times10^{-10}$ M, more preferably not greater than $2.5\times10^{-11}$ M, still more preferably not greater than $5\times10^{-12}$ M, and even more preferably not greater than $1\times10^{-12}$ M, and (b) dissociation constant with monkey TfR: preferably not greater than $1\times10^{-9}$ M, more preferably not greater than $5\times10^{-10}$ M, and still more preferably not greater than $1\times10^{-10}$ M, for example, not greater than $7.5\times10^{-11}$ M.

For example, the dissociation constants with hTfR and monkey TfR are not greater than $1\times10^{-10}$ M and not greater than $1\times10^{-9}$ M, not greater than $1\times10^{-11}$ M and not greater than $5\times10^{-10}$ M, not greater than $5\times10^{-12}$ M and not greater than $1\times10^{-10}$ M, not greater than $5\times10^{-12}$ M and not greater than $7.5\times10^{-11}$ M, not greater than $1\times10^{-12}$ M and not greater than $1\times10^{-10}$ M, or not greater than $1\times10^{-12}$ M and not greater than $7.5\times10^{-11}$ M, respectively. In this context, although there is no particularly definite lower limit on the dissociation constant with human TfR, it can be, for example, $5\times10^{-13}$ M or $1\times10^{-13}$ M. Although there is no particularly definite lower limit on the dissociation constant with monkey TfR, it can be, for example, $1\times10^{-11}$ M or $1\times10^{-12}$ M. The same also applies if the antibody is a single-chain antibody.

If an antibody having a relatively high-affinity to hTfR and obtained by the above method in which those cells producing a high affinity antibody were selected, is an antibody of a non-human animal, it may be converted to a humanized antibody. A humanized antibody is an antibody produced by using an amino acid sequence of part of the variable region (e.g., the whole or part of the CDRs) of a non-human animal antibody, and replacing a proper region of a human antibody with the sequence (which is implanted in the human antibody) while maintaining the specificity to the antigen. Examples of humanized antibodies include an antibody produced by replacing the three complementarity determining regions (CDRs) in the immunoglobulin light chain and the three complementarity determining regions (CDRs) in the immunoglobulin heavy chain, both constituting a human antibody, with CDRs of a non-human mammal. Though there is no particular limitation as to the biological species from which the CDRs to be incorporated into the human antibody are derived so long as it is a non-human mammal, it preferably is a mouse, rat, rabbit, horse, and non-human primate, more preferably a mouse and rat, and still more preferably a mouse. However, it may be an antibody in which part of a human antibody is replaced with part of a different human antibody.

Methods for preparation of humanized antibody are well known in the art and the most common is a method in which the amino acid sequence of the complementarity determining regions (CDRs) in the variable region of a human antibody is replaced with the CDRs of an antibody of non-human mammal, as devised by Winter et al. (Verhoeyen M. Science. 239. 1534-1536 (1988)). It is also well known that in some cases, corresponding part of an acceptor human antibody needs to be replaced not only with the CDRs of the non-human mammalian antibody but also amino acid sequences occurring in regions outside the CDRs that play a role either in maintaining the structure of the CDRs or in binding to the antigen, in order to reproduce the activity that the donor antibody originally possesses (Queen C. Proc. Natl. Acad. Sci. USA. 86. 10029-10033 (1989)). Here, the regions outside the CDRs are called framework (FR) regions.

Both the heavy chain and light chain variable regions of an antibody comprise four framework regions 1 to 4 (FR1 to FR4). FR1 is a region adjacent to CDR1 on the N-terminal side thereof, and consists of an amino acid sequence from the N-terminus in each peptide constituting the heavy chain and the light chain to an amino acid adjacent to the N-terminus of CDR1 thereof. FR2 consists of an amino acid sequence between CDR1 and CDR2 in each peptide constituting the heavy chain and the light chain. FR3 consists of an amino acid sequence between CDR2 and CDR3 in each peptide constituting the heavy chain and the light chain. FR4 consists of an amino acid sequence from an amino acid adjacent to the C-terminus of CDR3 to the C-terminus of the variable region. However, in the present invention, which is not limited thereby, a region excluding 1 to 5 N-terminal side amino acids and/or 1 to 5 C-terminal side amino acids in each FR region mentioned above may be used as the framework region.

Preparation of humanized antibody involves processes of implanting the CDRs (and their neighboring FRs, as the case may be) of non-human mammalian antibody in place of the CDRs (and their neighboring FRs, as the case may be) in the variable region of a human antibody. In such processes, the starting framework region of the variable region of a human antibody can be obtained from a public DNA database and the like which includes germ line antibody genes. For example, germ line DNA sequences, as well as amino acid sequences, of human heavy chain and light chain variable regions can be selected from "VBase" human germline database (available in the Internet, at www.mrc-cpe.cam.a-c.uk/vbase). Besides, they can be selected from publicized DNA sequences and amino acid sequences described in literatures, such as "Kabat E A. Sequences of Proteins of Immunological Interest, 5th Ed., U.S. Depaitment of Health and Human Services, NIH Publication No. 91-3242 (1991)"; "Tomlinson I M. J. fol. Biol. 227. 776-98 (1992)"; and "Cox J P L. Eur. J Immunol 24:827-836 (1994)".

As aforementioned, in a humanized antibody, the regions of a non-human mammalian animal antibody to be implanted into the variable regions of the original human antibody generally include CDRs themselves, or CDRs and their neighboring part of FRs. However, such FRs implanted together with CDRs also play a role either in maintaining the structure of the CDRs or in binding to the antigen, thus having a substantial function in determining the complementarity of an antibody, and the term "CDR" in the present invention, therefore, refers to such regions that are, or could be, taken from a non-human mammalian animal antibody and implanted into a humanized antibody, in preparing a humanized antibody. Thus, a region generally considered to be in a FR region is included in a CDR in the present invention as far as it takes part either in maintaining the structure of the CDR or in binding to the antigen, and is thus considered to have a substantial function in determining the complementarity of the antigen.

The anti-hTfR antibody of the present invention, when administered to the body, e.g., by intravenous injection, efficiently binds to hTfR occurring on the endothelial cells of the capillaries in the brain. The antibody bound to the hTfR is taken into the brain across the blood-brain barrier by such mechanisms as endocytosis, and transcytosis. Therefore, by binding them to the anti-hTfR antibody of the present invention, those proteins, low-molecular-weight compounds and the like that need to be brought into function in the brain, can be efficiently delivered into the brain across the blood-brain barrier. Further, the anti-hTfR antibody of the present invention can, after passing through the blood-brain barrier, can reach the cerebral parenchyma, and nerve-like cells in the hippocampus; Purkinje cells and the like of the cerebellum or at least one of them. And it is also expected that it reaches to the nerve-like cells in the striatum of the cerebrum; and the nerve-like cells in the substantia nigra of the mesencephalon. Therefore, it is possible to make one of those proteins, low-molecular-weight compounds and the like, which could act on such tissues or cells, reach the tissues or cells, by binding it to the anti-hTfR antibody of the present invention.

The anti-hTfR antibody of the present invention can be an effective means to make those compounds (proteins, low-molecular-weight compounds and the like) transfer from the blood into the brain and function there, which compounds otherwise cannot pass through the blood-brain barrier when intravenous administered and therefore cannot or can hardly exhibit their physiological or pharmacological functions in the brain. In particular, the anti-hTfR antibody of the present invention can, after passing through the blood-brain barrier, reach the cerebral parenchyma, and nerve-like cells in the hippocampus; Purkinje cells and the like of the cerebellum or at least one of them. And it is also expected that it reaches to the nerve-like cells in the striatum of the cerebrum; as well as to the nerve-like cells in the substantia nigra of the mesencephalon. Therefore, it is possible to make those compounds function or augment their function, in those tissues or cells in the brain by administering those compounds in a combined form with the anti-hTfR antibody molecule, parenterally, e.g., intravenously.

For binding an anti-hTfR antibody to such compounds (proteins, low-molecular-weight compounds and the like), a method is available to bind them together via a non-peptide linker or a peptide linker. As non-peptide linkers, there can be used polyethylene glycol, polypropylene glycol, copolymer of ethylene glycol and propylene glycol, polyoxyethylated polyol, polyvinyl alcohol, polysaccharides, dextran, polyvinyl ether, biodegradable polymer, polymerized lipid, chitins, and hyaluronic acid, or derivatives thereof, or combinations thereof. A peptide linker is a peptide chain consisting of 1 to 50 amino acids linked by peptide bonds or a derivative thereof, whose N-terminus and C-terminus are to be covalently bonded either to an anti-hTfR antibody or a compound such as protein, low-molecular-weight compound and the like, respectively, to bind the anti-hTfR antibody to such a compound like protein, low-molecular-weight compound.

In particular, a conjugate which is formed by binding the anti-hTfR antibody of the present invention to a desired different protein (A) via PEG as a non-peptide linker, is designated "anti-hTfR antibody-PEG-protein". An anti-hTfR antibody-PEG-protein can be prepared by first binding the anti-hTfR antibody to PEG to form anti-hTfR antibody-PEG, and then binding the anti-hTfR antibody-PEG to the different protein (A). Alternatively, an anti-hTfR antibody-PEG-protein can be prepared by first binding the different protein (A) to PEG to form "protein-PEG", and then binding the "protein-PEG" to the anti-hTfR antibody. In order to bind PEG to the anti-hTfR antibody and the different protein (A), a PEG is employed which is modified with such functional groups as carbonate, carbonylimidazole, active ester of carboxylic acid, azlactone, cyclic imide thione, isocyanate, isothiocyanate, imidate, aldehyde or the like. Such a functional group introduced to PEG reacts mainly with amino groups in the anti-hTfR antibody and a different protein (A) to covalently bind PEG to the hTfR antibody and a different protein (A). Though there is no particular limitation as to the molecular weight and the configuration of PEG employed here, its mean molecular weight (MW) is as follows: preferably MW=500 to 60000, more preferably MW=500 to 20000. For example, such PEG whose mean molecular weight is about 300, about 500, about 1000, about 2000, about 4000, about 10000, about 20000, and the like. PEG is preferably used as a non-peptide linker. The anti-hTfR antibody can be bound to a desired low-molecular-weight compound in the same manner as above.

For example, "anti-hTfR antibody-PEG" can be prepared by mixing the anti-hTfR antibody with a polyethylene glycol having aldehyde groups as functional groups (ALD-PEG-ALD) so that the molar ratio of ALD-PEG-ALD to the antibody is 11, 12.5, 15, 110, 120 and the like, and then adding to the mixture a reducing agent such as $NaCNBH_3$ to let a reaction take place. Then, by reacting "anti-hTfR antibody-PEG" with a different protein (A) in the presence of a reducing agent such as $NaCNBH_3$, "anti-hTfR antibody-PEG-protein" is obtained. On the contrary, it is also possible to obtain "anti-hTfR antibody-PEG-protein" by first binding a different protein (A) to ALD-PEG-ALD to prepare "protein-PEG", and then binding the "protein-PEG" to the anti-hTfR antibody.

The anti-hTfR antibody and a different protein (A) can also be bound together through peptide bonds by linking the anti-hTfR antibody heavy chain or light chain, on the C-terminal side or the N-terminal side thereof, either via a linker sequence or directly, to the N-terminus or the C-terminus of the different protein (A), respectively. Thus the fusion protein between the anti-hTfR antibody and a different protein (A) can be obtained by incorporating into a mammalian expression vector a DNA fragment in which a cDNA encoding the different protein (A) is placed in-frame directly, or via a DNA fragment encoding a linker sequence, on the 3'-end or 5'-end side of a cDNA encoding the heavy chain or light chain of the anti-hTfR antibody, and culturing mammalian cells into which the above expression vector has been introduced. Where the DNA fragment encoding a different protein (A) is linked to the heavy chain, a mammalian expression vector in which a cDNA fragment encoding the anti-hTfR antibody light chain is also introduced into the same host cells, whereas if DNA fragment encoding a different protein (A) is linked to the light chain, a mammalian expression vector in which a cDNA fragment encoding the anti-hTfR antibody heavy chain is also incorporated into the same host cells. In the case where the anti-hTfR antibody is a single-chain antibody, the fusion protein comprising the anti-hTfR antibody and a different protein (A) combined can be obtained by incorporating, into an expression vector (for eukaryotic cells such as mammalian and yeast, or for prokaryotic cells such as E. coli.), a DNA fragment which is formed by linking the cDNA encoding a different protein (A), on the 5'-end side or on the 3'-end side thereof, directly or via a DNA fragment encoding a linker sequence, to the cDNA encoding the single-chain anti-hTfR antibody, and allowing the fusion protein be expressed in those cells into which the expression vector has been introduced.

In a fusion protein of the type in which a different protein (A) is linked to the anti-hTfR antibody light chain on the C-terminal side thereof, the anti-human transferrin receptor antibody comprises an amino acid sequence including the whole or part of the light chain variable region and an amino acid sequence including the whole or part of the heavy chain variable region, and the different protein (A) is linked to the light chain of this anti-human transferrin receptor antibody on the C-terminal side thereof. Here, the anti-hTfR antibody light chain and a different protein (A) may be linked together, directly or via a linker.

In a fusion protein of the type in which a different protein (A) is linked to the anti-hTfR antibody heavy chain on the C-terminal side thereof, the anti-human transferrin receptor antibody comprises an amino acid sequence including the whole or part of the light chain variable region and an amino acid sequence including the whole or part of the heavy chain variable region, and the different protein (A) is linked to the heavy chain of this anti-human transferrin receptor antibody on the C-terminal side thereof. Here, the anti-hTfR antibody heavy chain and a different protein (A) may be linked together, directly or via a linker.

In a fusion protein of the type in which a different protein (A) is linked to the anti-hTfR antibody light chain on the N-terminal side thereof, the anti-human transferrin receptor antibody comprises an amino acid sequence including the whole or part of the light chain variable region and an amino acid sequence including the whole or part of the heavy chain variable region, and the different protein (A) is linked to the light chain of this anti-human transferrin receptor antibody on the N-terminal side thereof. Here, the anti-hTfR antibody light chain and a different protein (A) may be linked together, directly or via a linker.

In a fusion protein of the type in which a different protein (A) is linked to the anti-hTfR antibody heavy chain on the N-terminal side thereof, the anti-human transferrin receptor antibody comprises an amino acid sequence including the whole or part of the light chain variable region and an amino acid sequence including the whole or part of the heavy chain variable region, and the different protein (A) is linked to the heavy chain of this anti-human transferrin receptor antibody on the N-terminal side thereof. Here, the anti-hTfR antibody heavy chain and a different protein (A) may be linked together, directly or via a linker.

In the above, the linker sequence placed between the anti-hTfR antibody and a different protein (A) may be a peptide chain consisting preferably of 1 to 50, more preferably of 1 to 17, still more preferably of 1 to 10, even more preferably of 1 to 5 amino acids, and in accordance with the different protein (A) to be linked to the anti-hTfR antibody, the number of amino acids of the linker sequence may be adjusted to 1, 2, 3, 1-17, 1-10, 10-40, 20-34, 23-31, 25-29, 27, etc., as desired. Though there is no particular limitation as to amino acid sequence of the linker sequence insofar as the anti-hTfR antibody linked by it retains the affinity to hTfR and a different protein (A) linked by the linker sequence also exhibit the protein's own physiological activity under a physiological condition, the linker may preferably be composed of glycine and serine. Examples or such linkers include one consisting of a single amino acid either glycine or serine, the amino acid sequence Gly-Ser, the amino acid sequence Gly-Gly-Ser, the amino acid sequence Gly-Gly-Gly-Gly-Ser (SEQ ID NO:3), the amino acid sequence Gly-Gly-Gly-Gly-Gly-Ser (SEQ ID NO:4), the amino acid sequence Ser-Gly-Gly-Gly-Gly (SEQ ID NO:5), or a sequence which includes 1-10 or 2-5 of any of those amino acid sequences consecutively linked. They have sequences consisting of 1-50, 2-17, 2-10, 10-40, 20-34, 23-31, 25-29, or 27 amino acids. For example, those comprising the amino acid sequence Gly-Ser may preferably be used as linker sequences. Further, a linker sequence comprising 27 amino acids is preferably used that is composed of the amino acid sequence Gly-Ser followed by consecutively linked five copies of the amino acid sequence Gly-Gly-Gly-Gly-Ser (SEQ ID NO:3). Still further, a linker sequence comprising 25 amino acids is also preferably used that is composed of consecutively linked five copies of the amino acid sequence Gly-Gly-Gly-Gly-Ser (SEQ ID NO: 3).

In a fusion protein of the anti-hTfR antibody and a different protein (A), where the anti-hTfR antibody is a single-chain antibody, the amino acid sequence including the whole or part of the immunoglobulin light chain variable region and the amino acid sequence including the whole or part of the immunoglobulin heavy chain variable region are linked, generally via a linker sequence. Insofar as the affinity of the anti-hTfR antibody to hTfR is retained, the amino acid sequence derived from the light chain may be linked, on the C-terminal side thereof, to a linker sequence which in turn being linked, on the C-terminal side thereof, to the amino acid sequence derived from the heavy chain or, conversely, the amino acid sequence derived from the heavy chain may be linked, on the C-terminal side thereof, to a linker sequence which in turn being linked, on the C-terminal side thereof, to the amino acid sequence derived from the light chain.

The linker sequence placed between the light chain and the heavy chain of the immunoglobulin is a peptide chain consisting preferably of 2-50, more preferably 8-50, still more preferably 10-30, even more preferably 12-18 or 15-25, and for example 15 or 25 amino acids. Though there is no specific limitation as to the linker sequence insofar as the anti-hTfR antibody made of the both chains which are linked via the linker retains the affinity to hTfR and a different protein (A) linked to the antibody also exhibits the protein's own physiological activity under a physiological condition, the linker is preferably composed of glycine, or glycine and serine. Examples of such linkers include the amino acid sequence Gly-Ser, the amino acid sequence Gly-Gly-Ser, the amino acid sequence Gly-Gly-Gly, the amino acid sequence Gly-Gly-Gly-Gly-Ser (SEQ ID NO:3), the amino acid sequence Gly-Gly-Gly-Gly-Gly-Ser (SEQ ID NO:4), the amino acid sequence Ser-Gly-Gly-Gly-Gly (SEQ ID NO:5), or a sequence which includes 2-10 or 2-5 of any of these amino acid sequences consecutively linked. A preferred embodiment of such a linker sequence comprises 15 amino acids consisting of consecutively linked three copies of the amino acid sequence Gly-Gly-Gly-Gly-Ser (SEQ ID NO:3).

In the case where the anti-hTfR antibody is a single-chain antibody, an example of specific embodiments of the fusion protein between the humanized anti-hTfR antibody of the present invention and a different protein (A) is a fusion protein consisting of the different protein (A) which is linked, on the C-terminal side thereof and via a first linker sequence consisting of 27 amino acids composed of the amino acid sequence Gly-Ser followed by consecutively linked five copies of the amino acid sequence Gly-Gly-Gly-Gly-Ser (SEQ ID NO:3), to the single-chain antibody. An example of a preferred embodiment of single-chain antibodies employed here is an antibody having the amino acid sequence set forth as SEQ ID NO:60, which is composed of the amino acid sequence of the anti-hTfR antibody No. 3N heavy chain variable region set forth as SEQ ID NO:65 that is linked, at the C-terminus thereof and via a first linker sequence consisting of 15 amino acids consisting of consecutively linked three copies of the amino acid sequence Gly-Gly-Gly-Gly-Ser (SEQ ID NO:3), to the anti-hTfR antibody light chain variable region having the amino acid sequence set forth as SEQ ID NO:18, an antibody having the amino acid sequence set forth as SEQ ID NO:98, which is composed of the amino acid sequence of the Fab heavy chain of the anti-hTfR antibody No. 3N set forth as SEQ ID NO:61 that is linked, at the C-terminus thereof and via a linker sequence consisting of 32 amino acids consisting of consecutively linked six copies of the amino acid sequence set forth asSEQ ID NO:3 followed by the amino acid sequence of Gly-Gly, to the anti-hTfR antibody light chain variable region having the amino acid sequence set forth as SEQ ID NO:23.

Where the anti-hTfR antibody is a single-chain antibody, such a fusion protein can be produced by, for example, transforming host cells such as mammalian cells with an expression vector having an incorporated DNA fragment containing a nucleotide sequence encoding the fusion protein, and then culturing the host cells.

Besides, in the present invention, when a peptide chain includes a plurality of linker sequences, each of those linker sequences is designated, from the N-terminal side, the first linker sequence, the second linker sequence, and so on, for convenience.

In the case where the anti-hTfR antibody is Fab, an example of specific embodiments of the fusion protein between a humanized anti-hTfR antibody and a different protein (A) of the present invention is a fusion protein which is composed of the different protein (A) that is fused, on the C-terminal side thereof and via a linker sequence consisting of 27 amino acids composed of Gly-Ser followed by consecutively linked five copies of the amino acid sequence Gly-Gly-Gly-Gly-Ser (SEQ ID NO:3), to a region having the anti-hTfR antibody heavy chain variable region and the $C_H1$ region. Though part of the hinge region may be included in addition to the $C_H1$ region here, the hinge region includes no cysteine residue which would form a disulfide bond between heavy chains.

In the case where the anti-hTfR antibody is Fab, an example of a preferred heavy chain is one having the amino acid sequence set forth as SEQ ID NO: 61. The amino acid sequence set forth as SEQ ID NO: 61 is Fab of the heavy chain of humanized anti-hTfR antibody No. 3N having the amino acid sequence set forth as SEQ ID NO: 66, and corresponds to a portion at positions 1 to 226 from the N-terminal side of the amino acid sequence set forth as SEQ ID NO: 66. Besides, a portion at positions 1 to 118 from the N-terminus of SEQ ID NO: 61 corresponds to the variable region (SEQ ID NO: 65), a portion at positions 119 to 216 corresponds to the $C_H1$ region, and a portion at positions 217 to 226 corresponds to the hinge region.

In the case where the anti-hTfR antibody is Fab, the Fc region of different IgG may be further introduced in the fusion protein. By introducing the Fc region in the fusion protein, it is possible to enhance the stability of the fusion protein in the body, such as in blood. Such a fusion protein with the Fc region introduced therein is, for example, the one in which a human IgG Fc region is linked, directly or via a linker sequence, to the different protein (A) on the C-terminal side thereof, and the Fab heavy chain of the anti-human transferrin receptor antibody is linked, directly or via a linker sequence, to the human IgG Fc region on the C-terminal side thereof.

The linker sequence between the different protein (A) and the human IgG Fc region consists preferably of 1 to 50 amino acids. In this context, the number of amino acids is adjusted to 1-17, 1-10, 10-40, 20-34, 23-31, 25-29, 27, etc., as desired. Though there is no particular limitation as to amino acid sequence of the linker sequence, the linker may preferably be composed of glycine and serine. Examples of such linkers include one consisting of a single amino acid either glycine or serine, the amino acid sequence Gly-Ser, the amino acid sequence Gly-Gly-Ser, the amino acid sequence Gly-Gly-Gly-Gly-Ser (SEQ ID NO: 3), the amino acid sequence Gly-Gly-Gly-Gly-Gly-Ser (SEQ ID NO: 4), the amino acid sequence Ser-Gly-Gly-Gly-Gly (SEQ ID NO: 5), or a sequence which has 1-10 or 2-5 of any of those amino acid sequences consecutively linked, and includes a sequence consisting of not more than 50 amino acids or a sequence consisting of 2-17, 2-10, 10-40, 20-34, 23-31, 25-29, or 25 amino acids. For example, a linker sequence comprising 25 amino acids is preferably used that is composed of consecutively linked five copies of the amino acid sequence Gly-Gly-Gly-Gly-Ser (SEQ ID NO: 3). The same also applies for the linker sequence between the human IgG Fc region and the Fab heavy chain.

Besides, when introducing the human IgG Fc region, the human IgG Fc region may be linked to either of the heavy chain or the light chain of the anti-human transferrin receptor antibody. Further, the antibody may be other antigen-binding fragments including F(ab')$_2$, F(ab'), and a single-chain antibody.

There is no particular limitation as to the IgG type of the human IgG Fc region to be introduced, and it may be any of IgG1 to IgG5. Further, the human IgG Fc region to be introduced may be the whole Fc region or may be part thereof. A preferred embodiment of such a human IgG Fc region is one having the amino acid sequence set forth as SEQ ID NO: 70, which is the whole region of human IgG1 Fc. Further, the amino acid sequence of the Fab heavy chain with the human IgG Fc region added thereto is one having the amino acid sequence set forth as SEQ ID NO: 71 in which the human IgG Fc region having the amino acid sequence set forth as SEQ ID NO: 70 is linked, via a linker sequence comprising 25 amino acids that is composed of consecutively linked five copies of the amino acid sequence Gly-Gly-Gly-Gly-Ser (SEQ ID NO: 3), to the N-terminal side of the amino acid sequence of the Fab heavy chain (SEQ ID NO: 61) of the humanized anti-hTfR antibody 3N.

The fusion protein between an anti-hTfR antibody and a different protein (A) can be modified so as to have an affinity to albumin. The affinity to albumin can be attained by binding to the fusion protein a compound, a peptide, a protein or the like having an affinity to albumin. The fusion protein, into which an affinity to albumin has been introduced, is at least partially bound to albumin, and circulated in blood. Albumin has a function of stabilizing a protein bound thereto. Therefore, by introducing an affinity to albumin, the in-blood half-life of the fusion protein administered in a living body can be extended, so that the pharmacological effect of the fusion protein can be enhanced. Introduction of an affinity to albumin is more effective when the anti-hTfR antibody is an antibody lacking a Fc region contributing to stability of the antibody, e.g. Fab.

Introduction of an affinity to albumin is also effective when the fusion protein between an anti-hTfR antibody and a different protein (A) shows immunogenicity when administered in a living body. With the fusion protein bound to albumin, a site of the fusion protein which shows immunogenicity is inhibited from being presented to immune cells, so that immunogenicity is reduced.

When an affinity to albumin is introduced into the fusion protein between an anti-hTfR antibody and a different protein (A), the region into which the affinity is introduced may be any one of a light chain of the anti-hTfR antibody, a heavy chain of the anti-hTfR antibody, a different protein (A) and a linker region, or the affinity may be introduced into two or more of these regions.

As peptides or proteins having an affinity to albumin, for example, there can be used, among others, peptides in which an albumin-binding domain of a protein derived from *Streptococcus* strain G418 (Alm T. Biotechnol J. 5. 605-17 (2010)) having an amino acid sequence set forth as SEQ ID NO: 74 are modified so as to have alkali resistance. For binding together a peptide or protein having an affinity to albumin (albumin-affinitive peptide) and a fusion protein between an anti-hTfR antibody and a different protein (A) (anti-hTfR antibody-protein (A) fusion protein), a method is available to bind them together via a non-peptide linker or a peptide linker. As non-peptide linkers, there can be used polyethylene glycol, polypropylene glycol, copolymer of ethylene glycol and propylene glycol, polyoxyethylated polyol, polyvinyl alcohol, polysaccharides, dextran, polyvinyl ether, biodegradable polymer, lipid polymer, chitins, and hyaluronic acid, or derivatives thereof, or combinations thereof. The peptide linker is a peptide chain consisting of 1 to 50 amino acids linked by peptide bonds or a derivative thereof, whose N-terminus and C-terminus are covalently bonded either to an albumin-affinitive peptide or a fusion protein, respectively, to bind the albumin-affinitive peptide and the fusion protein together.

In particular, a conjugate, which is formed by binding the albumin-affinitive peptide to the fusion protein between an anti-hTfR antibody and a different protein (A) via PEG as a non-peptide linker, is designated "albumin-affinitive peptide-PEG-protein (A) fusion protein". An albumin-affinitive peptide-anti-hTfR antibody-protein (A) fusion protein can be prepared by binding the albumin-affinitive peptide to PEG to form an albumin-affinitive peptide-PEG, and then binding the albumin-affinitive peptide-PEG to an anti-hTfR antibody-protein (A) fusion protein. Alternatively, an albumin-affinitive peptide-anti-hTfR antibody-protein (A) fusion protein can be prepared by binding an anti-hTfR antibody-protein (A) fusion protein to PEG to form an anti-hTfR antibody-protein (A) fusion protein, and then binding the anti-hTfR antibody-protein (A) fusion protein-PEG to an albumin-affinitive peptide. In order to bind PEG to the albumin-affinitive peptide and the anti-hTfR antibody-protein (A) fusion protein, a PEG is employed which is modified with such functional groups as carbonate, carbonylimidazole, active ester of carboxylic acid, azlactone, cyclic imide thione, isocyanate, isothiocyanate, imidate, aldehyde or the like. Such a functional group introduced to PEG reacts mainly with amino groups in the molecules of the albumin-affinitive peptide and the anti-hTfR antibody-protein (A) fusion protein to covalently bind PEG to the albumin-affinitive peptide and the anti-hTfR antibody-protein (A) fusion protein. Though there is no particular limitation as to the molecular weight and the configuration of PEG employed here, its mean molecular weight (MW) is as follows: preferably MW=500 to 60000, more preferably MW=500 to 20000. For example, such PEG whose mean molecular weight is about 300, about 500, about 1000, about 2000, about 4000, about 10000, about 20000, and the like. PEG is preferably used as a non-peptide linker.

For example, an albumin-affinitive peptide-PEG can be prepared by mixing an albumin-affinitive peptide with an aldehyde group-modified PEG (ALD-PEG-ALD) in such a manner that the molar ratio of the modified PEG to the albumin-affinitive peptide is 11, 12.5, 15, 110, 120 or the like, and then adding to the mixture a reducing agent such as $NaCNBH_3$ to let a reaction take place. Then, by reacting the albumin-affinitive peptide-PEG with an anti-hTfR antibody-protein (A) fusion protein in the presence of a reducing agent such as $NaCNBH_3$, an albumin-affinitive peptide-PEG-anti-hTfR antibody-protein (A) fusion protein is obtained. On the contrary, it is also possible to obtain an albumin-affinitive peptide-PEG-anti-hTfR antibody-protein (A) fusion protein by first binding an anti-hTfR antibody-protein (A) fusion protein to ALD-PEG-ALD to prepare an anti-hTfR antibody-protein (A) fusion protein-PEG, and then binding the fusion protein-PEG to an albumin-affinitive peptide.

It is also possible to fuse the anti-hTfR antibody-protein (A) fusion protein to the albumin-affinitive peptide. The fusion protein (anti-hTfR antibody-protein (A) fusion protein-albumin-affinitive peptide) can be obtained by incorporating into a mammalian expression vector a DNA segment in which a cDNA encoding the albumin-affinitive peptide is placed in-frame directly, or via a DNA segment encoding a linker sequence, on the 3'-end or 5'-end side of a cDNA encoding the heavy chain (including a fusion protein between the heavy chain and the protein (A)) or the light chain (including a fusion protein between the light chain and the protein (A)) of the anti-hTfR antibody-protein (A) fusion protein, and culturing mammalian cells into which the expression vector has been introduced. When a DNA fragment encoding an albumin-affinitive peptide is bound to the heavy chain (or fusion protein between the heavy chain and the protein (A)), a mammalian expression vector in which a cDNA segment encoding a fusion protein between the light chain constituting the anti-hTfR antibody and the protein (A) (or light chain) has been incorporated is also introduced into the same host cells, whereas when a DNA segment encoding an albumin-affinitive peptide is bound to the light chain (or fusion protein between the light chain and the protein (A)), a mammalian expression vector in which a cDNA segment encoding a fusion protein between the heavy chain of the anti-hTfR antibody and the protein (A) (or heavy chain) has been incorporated is also introduced into the same host cells. That is, the albumin-affinitive peptide may be bound either on the N-terminal or C-terminal side of the heavy chain (including a fusion protein between the heavy chain and the protein (A)) or the light chain (including a fusion protein between the light chain and the protein (A)) of the anti-hTfR antibody-protein (A) fusion protein, but when the protein (A) is bound to the heavy chain of the anti-hTfR antibody on the N-terminal side, it is preferable to bind the albumin-affinitive peptide on the C-terminal side of the anti-hTfR antibody, and it is particularly preferable to bind the albumin-affinitive peptide on the C-terminal side of the heavy chain.

The anti-hTfR antibody-protein (A) fusion protein can be fused with the albumin-affinitive peptide directly, or via a linker sequence. Here, the linker sequence consists of preferably 1 to 50 amino acids. Here, the number of amino acids is adjusted to 1-17, 1-10, 10-40, 20-34, 23-31, 25-29, 27, etc., as appropriate. Though there is no limitation as to the amino acid sequence of the linker sequence, the linker sequence preferably consists of glycine and serine. Examples of the linkers include those having sequences consisting of 1-50, 2-17, 2-10, 10-40, 20-34, 23-31, 25-29 or 25 amino acids, where the linker consists of one of amino acids: glycine and serine, the amino acid sequence: Gly-Ser, the amino acid sequence Gly-Gly-Ser, the amino acid sequence Gly-Gly-Gly-Gly-Ser (SEQ ID NO: 3), the amino acid sequence Gly-Gly-Gly-Gly-Gly-Ser (SEQ ID NO: 4), the amino acid sequence Ser-Gly-Gly-Gly-Gly (SEQ ID NO: 5), or a sequence which includes 1 to 10 or 2 to 5 of any of those amino acid sequences consecutively linked. For example, a linker sequence comprising total 15 amino acids may be preferably used which consists of three consecutively linked copies of amino acid sequence: Gly-Gly-Gly-Gly-Ser (SEQ ID NO: 3).

The binding affinity to albumin of the anti-hTfR antibody-protein (A) fusion protein in which an albumin-affinitive peptide has been introduced is preferably not greater than $1 \times 10^{-7}$ M, more preferably not greater than $5 \times 10^{-7}$ M, still more preferably not greater than $1 \times 10^{-8}$ M, even more preferably not greater than $1 \times 10^{-9}$ M as measured by biolayer interferometry as described in Example 7.

The Fab antibody can be stabilized in blood even by a method other than introduction of a Fc region or an albumin-affinitive peptide. For example, the Fab antibody can be stabilized by PEG-modifying the Fab antibody itself or a fusion between the Fab antibody and a different protein. Such a method is generally carried out in the field of protein pharmaceuticals, and PEGylated erythropoietin, interferon, etc. have been put into practical use as pharmaceutical products. The Fab antibody can also be stabilized by introducing a mutation into the Fab antibody. For example, the Fab antibody can be stabilized by replacing methionine at position 4 from the N-terminal side of the light chain with leucine. However, the method for introducing a mutation is not limited thereto, and a mutation may be introduced into the heavy chain. In addition, the method for stabilizing the Fab antibody is not limited to those described above, and all well known methods can be utilized.

Though there is no particular limitation as to the different protein (A) to be linked to the anti-hTfR antibody, it is a protein that can exhibit its physiological activity in the body, and in particular, such a protein that needs to get inside the brain and exhibit its function there but, due to its inability to pass through the blood-brain barrier as it is, cannot be expected to function in the brain if simply administered intravenously. Examples of such proteins include lysosomal enzymes such as nerve growth factor (NGF), α-L-iduronidase (IDUA), iduronate 2-sulfatase (IDS), glucocerebrosidase (GBA), β-galactosidase, GM2 activator protein, β-hexosaminidase A, β-hexosaminidase B, N-acetylglucosamine-1-phosphotransferase, α-mannosidase (LA-MAN), β-mannosidase, galactosylceramidase (GALC), saposin C, arylsulfatase A (ARSA), α-L-fucosidase (FUCA1), aspartylglucosaminidase, α-N-acetylgalactosaminidase, acidic sphingomyelinase (ASM), α-galactosidase A, β-glucuronidase (GUSB), heparan N-sulfatase (SGSH), α-N-acetylglucosaminidase (NAGLU), acetyl CoA:α-glucosaminide N-acetyltransferase, N-Acetylglucosamine-6-sulfate sulfatase, acid ceramidase (AC), amylo-1,6-glucosidase, sialidase, aspartylglucosaminidase, palmitoyl protein thioesterase 1 (PPT-1), tripeptidyl-peptidase 1 (TPP-1), hyaluronidase 1, acidic α-glucosidase (GAA), CLN1, and CLN2, and the like.

The nerve growth factor (NGF) linked to the anti-hTfR antibody can be used as a therapeutic agent for dementia in Alzheimer's disease; α-L-iduronidase (IDUA) linked to the anti-hTfR antibody as a therapeutic agent for central nervous system disorders in Hurler syndrome or Hurler-Scheie syndrome; iduronate 2-sulfatase (IDS) linked to the anti-hTfR antibody as a therapeutic agent for central nervous system disorders in Hunter syndrome; glucocerebrosidase (GBA) as a therapeutic agent for central nervous system disorders in Gaucher's disease; β-galactosidase as a therapeutic agent for central nervous system disorders in GM1 gangliosidosis Types 1-3; GM2 activator protein as a therapeutic agent for central nervous system disorders in GM2-gangliosidosis, AB variant; β-hexosaminidase A as a therapeutic agent for central nervous system disorders in Sandhoff's disease and Tay-Sachs disease; β-hexosaminidase B as a therapeutic agent for central nervous system disorders in Sandhoff's disease; N-acetylglucosamine-1-phosphotransferase as a therapeutic agent for central nervous system disorders in I-cell disease; α-mannosidase (LAMAN) as a therapeutic agent for central nervous system disorders in α-mannosidosis; β-mannosidase as a therapeutic agent for central nervous system disorders in β-mannosidosis; galactosylceramidase (GALC) as a therapeutic agent for central nervous system disorders in Krabbe disease; saposin C as a therapeutic agent for central nervous system disorders in Gaucher's disease-like storage disease; arylsulfatase A (ARSA) as a therapeutic agent for central nervous system disorders in metachromatic white matter degeneration (metachromatic leukodystrophy); α-L-fucosidase (FUCA1) as a therapeutic agent for central nervous system disorders in fucosidosis; aspartylglucosaminidase as a therapeutic agent for central nervous system disorders in aspartylglucosaminuria; α-N-acetylgalactosaminidase as a therapeutic agent for central nervous system disorders in Schindler disease and Kawasaki disease; acidic sphingomyelinase (ASM) as a therapeutic agent for central nervous system disorders in Niemann-Pick disease; α-galactosidase A as a therapeutic agent for central nervous system disorders in Fabry disease; β-glucuronidase (GUSB) as a therapeutic agent for central nervous system disorders in Sly syndrome; heparan N-sulfatase (SGSH), α-N-acetylglucosaminidase (NAGLU), acetyl CoA:α-glucosaminide N-acetyltransferase and N-Acetylglucosamine-6-sulfate sulfatase as therapeutic agents for central nervous system disorders in Sanfilippo syndrome; acid ceramidase (AC) as a therapeutic agent for central nervous system disorders in Farber disease; amylo-1,6-glucosidase as a therapeutic agent for central nervous system disorders in Cori's disease (Forbes-Cori's disease); sialidase as a therapeutic agent for central nervous system disorders in sialidase deficiency; palmitoyl protein thioesterase 1 (PPT-1) as a therapeutic agent for central nervous system disorders in neuronal ceroid lipofuscinosis or Santavuori-Haltia disease; tripeptidyl-peptidase 1 (TPP-1) as a therapeutic agent for central nervous system disorders in neuronal ceroid lipofuscinosis or Jansky-Bielschowsky disease; hyaluronidase 1 as a therapeutic agent for central nervous system disorders in hyaluronidase deficiency; acidic α-glucosidase (GAA) as therapeutic agents for central nervous system disorders in Pompe's disease; CLN1 and CLN2 as therapeutic agents for central nervous system disorders in Batten disease. In particular, the anti-hTfR antibody of the present invention, after passing through the blood-brain barrier, reaches the brain parenchyma and the hippocampus nerve-like cells of the cerebrum, and Purkinje cells of the cerebellum, and is expected further to reach nerve-like cells of the striatum of the cerebrum and the nerve-like cells of the substantia nigra of the mesencephalon. Therefore, the anti-hTfR antibody can be fused with proteins which need to exhibit their functions in those tissues or cells to strength the pharmacological effects of the proteins. Medical applications of it, however, are not limited thereto.

Besides, the one that is used as a therapeutic agent in the present invention may be used for preventing the onset of a disease.

Further, examples of proteins that can exhibit their pharmacological effects when linked to the anti-hTfR antibody include: lysosomal enzymes, ciliary neurotrophic factor (CNTF), glial cell line derived neurotrophic factor (GDNF), neurotrophin-3, neurotrophin-4/5, neurotrophin-6, neuregulin-1, erythropoietin, darbepoetin, activin, basic fibroblast growth factor (bFGF), fibroblast growth factor 2 (FGF2), epidermal growth factor (EGF), vascular endothelial growth factor (VEGF), interferon α, interferon β, interferon γ, interleukin 6, granulocyte-macrophage colony stimulating factor (GM-CSF), granulocyte colony stimulating factor (G-CSF), macrophage colony stimulating factor (M-CSF), cytokines, tumor necrosis factor α receptor (TNF-α receptor), PD-1 ligands, PD-L1, PD-L2, enzymes having β-amyloid-degrading activity, anti-β-amyloid antibody, anti-BACE antibody, anti-EGFR antibody, anti-PD-1 antibody, anti-PD-L1 antibody, anti-PD-L2 antibody, anti-HER2 antibody, anti-TNF-α antibody, anti-CTLA-4 antibody, and other antibody medicines.

Lysosomal enzymes linked to the anti-hTfR antibody can be used as a therapeutic agent for central nervous system disorders in lysosomal storage diseases; CNTF as a therapeutic agent for amyotrophic lateral sclerosis; GDNF, neurotrophin-3 and neurotrophin-4/5 as therapeutic agents for cerebral ischemia; GDNF as a therapeutic agent for Parkinson's disease; neuregulin-1 as a therapeutic agent for schizophrenia; erythropoietin and darbepoetin as therapeutic agents for cerebral ischemia; bFGF and FGF2 as therapeutic agents for traumatic central nervous system disorders; for recovery after brain surgery and spinal surgery; enzymes having β-amyloid-degrading activity, anti-β-amyloid antibody and anti-BACE antibody as therapeutic agents for Alzheimer's disease; anti-EGFR antibody, anti-PD-1 antibody, anti-PD-L1 antibody, anti-PD-L2 antibody, anti-HER2 antibody, and anti-CTLA-4 antibody, as therapeutic agents for tumors of central nervous system including brain tumor; and TNFαR-anti-hTfR antibody as therapeutic agents for a cerebral ischemia and encephalitis.

Possible candidates for a "different protein (A)" to be fused to the anti-hTfR antibody generally include those therapeutic agents for diseases such as neurodegenerative diseases such as Alzheimer's disease, Parkinson's disease, and Huntington's disease; mental disorders such as schizophrenia and depression; multiple sclerosis; amyotrophic lateral sclerosis; tumors of the central nervous system including brain tumor; lysosomal storage diseases accompanied by encephalopathy; glycogenosis; muscular dystrophy; cerebral ischemia; encephalitis; prion diseases; traumatic central nervous system disorders. In addition, therapeutic agent for viral and bacterial central nervous system diseases can also be candidates for a different protein (A) to be fused to the anti-hTfR antibody, in general. Further, pharmaceutical agents that can be used for recovery after brain surgery or spinal surgery can also be candidates for a "different protein (A)" to be fused to the anti-hTfR antibody, in general.

In addition to the above mentioned natural-type (wild-type) proteins, a different protein (A) to be linked to the anti-hTfR antibody may also be one of their analogues in which one or more amino acids of those natural-type (wild-type) proteins are modified, e.g., replaced with other amino acids or deleted, insofar as they fully or partly have the functions of their respective original proteins. When replacing one or more amino acids with other amino acids, the number of amino acids to be replaced is preferably 1-10, more preferably 1-5, still more preferably 1-3. When deleting one or more amino acids, the number of amino acids to be deleted is preferably 1-10, more preferably 1-5, still more preferably 1-3. A combination of such substitution and deletion of amino acids can also be carried out to prepare desired analogues. Further, amino acid sequences produced by adding one or more amino acids inside, or on the N-terminal side or on the C-terminal side of, the amino acid sequence of natural-type (wild-type) proteins or their analogues, are also included in the proteins mentioned above insofar as they fully or partly have the functions of their respective original proteins. The number of amino acids to be added here is preferably 1-10, more preferably 1-5, still more preferably 1-3. It is also possible to prepare desired analogues to the original proteins by combining addition, substitution, and deletion of amino acids.

Besides, in the case where a mutation is introduced into a different protein (A) by adding one or more amino acids on its C-terminus or the N-terminus, if the added amino acids are positioned between the protein and the anti-hTfR antibody when they are fused, the added amino acids constitute part of a linker.

The natural-type human acidic α-glucosidase (hGAA) is a lysosomal enzyme composed of 883 amino acids sequence set forth as SEQ ID NO: 55. However, one composed of 896 amino acids set forth as SEQ ID NO: 56 in which 13 amino acids are further added to the N-terminal side of the amino acid sequence set forth as SEQ ID NO: 55 is also included in the natural-type hGAA.

An example of specific embodiments of fusion proteins of the present invention between the anti-hTfR antibody and a different protein (A) is a type in which the anti-hTfR antibody heavy chain is linked, on the C-terminus thereof and via the amino acid sequence Gly-Ser, as a linker sequence, to the natural-type hGAA. Examples of such a type of fusion proteins include one whose light chain consists of the amino acid sequence set forth as SEQ ID NO: 23, and whose heavy chain consists of the amino acid sequence set forth as SEQ ID NO: 66 or 68, and is linked, on the C-terminal side thereof and via the linker sequence Gly-Ser, to hGAA, by peptide bonds. The one having the amino acid sequence set forth as SEQ ID NO: 66 is an IgG1-type anti-hTfR antibody, and the one having the amino acid sequence set forth as SEQ ID NO: 68 is an IgG4-type anti-hTfR antibody. A nucleotide sequence encoding the one having the amino acid sequence set forth as SEQ ID NO: 66 is set forth as, for example, SEQ ID NO: 67, and a nucleotide sequence encoding the one having the amino acid sequence set forth as SEQ ID NO: 68 is set forth as, for example, SEQ ID NO: 69.

The human acidic α-glucosidase (hGAA) is also called α-1,4-glucosidase or acidic maltase. hGAA has an activity of degrading glycogen by hydrolyzing the α-1,4- and α-1,6-glycoside bonds of the glycogen in lysosome. Pompe's disease, also called glycogen storage disease type II (GSD II), is a disease caused by intracellular glycogen accumulation associated with deficiency in acidic α-glucosidase (acidic maltase) activity in lysosome. Pompe's disease patients may manifest central nervous system disorders. hGAA conjugated with the anti-hTfR antibody can be used as a therapeutic agent for central nervous system disorders accompanying Pompe's disease.

In the present invention, though the term "human GAA" or "hGAA" refers, in particular, to the hGAA having the same amino acid sequence as the natural-type hGAA, it also includes those amino acid sequences produced by introducing a mutation, such as substitution, deletion, addition and the like, into the natural-type hGAA, insofar as they have the hGAA activity. When replacing one or more of the amino acids of the amino acid sequence of hGAA with other amino acids, the number of amino acids to be replaced is preferably 1-10, more preferably 1-5, still more preferably 1-3, even more preferably 1-2. When deleting one of more amino acids of the amino acid sequence of hGAA, the number of amino acids to be deleted is 1-10, more preferably 1-5, still more preferably 1-3, and even more preferably 1-2. It is also possible to introduce a combined mutation of such substitution and deletion of amino acids. When adding one or more amino acids to hGAA, they may be added, inside, or on the N-terminal side or the C-terminal side of, the amino acid sequence of hGAA, and the number of amino acids to be added is preferably 1-10, more preferably 1-5, still more preferably 1-3, even more preferably 1-2. It is also possible to introduce a combined mutation of such addition, substitution, and deletion. The amino acid sequence of the mutated hGAA has a homology of preferably not lower than 80%, more preferably not lower than 90%, still more preferably not lower than 95% to the amino acid sequence of the original hGAA.

The statement that hGAA has the hGAA activity herein means that the hGAA fused to anti-hTfR antibody has an activity not lower than 3% of the activity that the natural-type hGAA intrinsically has. However, the activity is preferably not lower than 10%, more preferably not lower than 20%, still more preferably not lower than 50%, even more preferably not lower than 80% of the activity that the natural-type hGAA intrinsically has. The same also applies if the hGAA fused to the anti-hTfR antibody is mutated.

The fusion protein between the anti-hTfR antibody and hGAA can be produced by, for example, transforming host cells, such as mammalian cells, with an expression vector having an incorporated DNA fragment comprising the nucleotide sequence set forth as SEQ ID NO: 59 that encodes the amino acid sequence set forth as SEQ ID NO: 58 and an expression vector having an incorporated DNA fragment comprising the nucleotide sequence set forth as SEQ ID NO: 24 that encodes the anti-hTfR antibody light chain having the amino acid sequence set forth as SEQ ID NO: 23, and then culturing the host cells. The fusion protein thus produced can be used as a therapeutic agent for Pompe's disease, in particular, a therapeutic agent for central nervous system disorders in Pompe's disease. The fusion protein obtained in this manner is a fusion protein of an IgG4-type humanized anti-hTfR antibody and hGAA.

Besides, in the case where the anti-hTfR antibody or hGAA is mutated by adding one or more amino acids to them on the C-terminus or the N-terminus thereof, if the added amino acids are positioned between the anti-hTfR antibody and hGAA, the added amino acids constitute part of a linker.

The natural-type human I2S (hI2S) is a lysosomal enzyme composed of 525 amino acids sequence set forth as SEQ ID NO:50. A specific example of fusion proteins of the present invention between the anti-hTfR antibody and a different protein (A) is a type in which the anti-hTfR antibody heavy chain is fused, on the C-terminus thereof and via the amino acid sequence Gly-Ser as a linker sequence, to the natural-type human I2S. Examples of such a type of fusion proteins include one whose light chain consists of the amino acid sequence set forth as SEQ ID NO: 23, and whose heavy chain is linked, on the C-terminal side thereof and via a linker consisting of the amino acid sequence Gly-Ser, to human I2S, by peptide bonds, to form the amino acid sequence set forth as SEQ ID NO: 53. The one having the amino acid sequence set forth as SEQ ID NO: 53 is a fusion product of the heavy chain of an IgG1-type anti-hTfR antibody and hI2S, and the heavy chain moiety has the amino acid sequence set forth as SEQ ID NO: 66. By replacing this heavy chain moiety with the amino acid sequence set forth as SEQ ID NO: 68, it is also possible to fuse an IgG4-type anti-hTfR antibody with hI2S.

The human I2S (hI2S) has an activity of hydrolyzing the sulfate bonds of heparan sulfate and dermatan sulfate belonging to glycosaminoglycan. Hunter syndrome patients having genetic abnormality in this enzyme result in symptoms such as skeletal abnormality as partial hydrolysates of heparan sulfate and dermatan sulfate accumulate in the tissues of the liver, the spleen and the like due to the abnormal metabolism of heparan sulfate and dermatan sulfate. Further, Hunter syndrome patients may manifest central nervous system disorders. hI2S conjugated with the anti-hTfR antibody can be used as a therapeutic agent for central nervous system disorders accompanying Hunter syndrome.

In the present invention, though the term "human I2S" or "hI2S" refers, in particular, to the hI2S having the same amino acid sequence as the natural-type hI2S, it also includes those amino acid sequences produced by introducing a mutation, such as substitution, deletion, addition and the like, into the amino acid sequence of the natural-type hI2S, insofar as they have the I2S activity. When replacing one or more of the amino acids of the amino acid sequence of hI2S with other amino acids, the number of amino acids to be replaced is preferably 1-10, more preferably 1-5, still more preferably 1-3, even more preferably 1-2. When deleting one or more amino acids of the amino acid sequence of hI2S, the number of amino acids to be deleted is 1-10, more preferably 1-5, still more preferably 1-3, and even more preferably 1-2. It is also possible to introduce a combined mutation of such substitution and deletion of amino acids. When adding one or more amino acids to hI2S, they may be added, inside, or on the N-terminal side or the C-terminal side of, the amino acid sequence of hI2S, and the number of amino acids to be added is preferably 1-10, more preferably 1-5, still more preferably 1-3, even more preferably 1-2. It is also possible to introduce a combined mutation of such addition, substitution, and deletion of the amino acid. The amino acid sequence of the mutated hI2S has a homology of preferably not lower than 80%, more preferably not lower than 90%, still more preferably not lower than 95% to the amino acid sequence of the original hI2S.

The statement that hI2S has the I2S activity herein means that the hI2S fused to anti-hTfR antibody has an activity not lower than 3% of the activity that the natural-type hI2S intrinsically has. However, the activity is preferably not lower than 10%, more preferably not lower than 20%, still more preferably not lower than 50%, even more preferably not lower than 80% of the activity that the natural-type hI2S intrinsically has. The same also applies if the hI2S fused to the anti-hTfR antibody is mutated.

The fusion protein between the anti-hTfR antibody and hGAA can be produced by, for example, transforming host cells, such as mammalian cells, with an expression vector having an incorporated DNA fragment comprising the nucleotide sequence set forth as SEQ ID NO:54 that encodes the amino acid sequence set forth as SEQ ID NO:53 and an expression vector having an incorporated DNA fragment comprising the nucleotide sequence set forth as SEQ ID NO:24 that encodes the amino acid sequence set forth as SEQ ID NO:23 (anti-hTfR antibody light chain), and then culturing the host cells. The fusion protein thus produced can be used as a therapeutic agent for Pompe's disease, in particular, a therapeutic agent for central nervous system disorders accompanying Pompe's disease. The fusion protein obtained in this manner is a fusion protein of an IgG1-type humanized anti-hTfR antibody and hGAA.

Besides, in the case where the anti-hTfR antibody or human I2S is mutated by adding one or more amino acids to them on the C-terminus or the N-terminus thereof, if the added amino acids are positioned between the anti-hTfR antibody and human I2S, the added amino acids constitute part of a linker.

The natural-type human α-L-iduronidase (hIDUA) is a lysosomal enzyme consisting of an amino acid sequence set forth as a SEQ ID NO: 75 or 76. The hIDUA set forth as SEQ ID NO: 76 is a type in which Ala-Pro is added on the N-terminal side of the amino acid sequence set forth as SEQ ID NO: 75.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hIDUA. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hIDUA by a peptide bond. An anti-hTfR antibody of IgG1 type has the amino acid sequence set forth as SE ID NO: 66, and an anti-hTfR antibody of IgG4 type has the amino acid sequence set forth as SEQ ID NO: 68.

The human α-L-iduronidase (hIDUA) is a lysosomal enzyme hydrolyzing an iduronic acid bond present in the dermatan sulfate or heparan sulfate molecule. The Hurler syndrome, which is also referred to as mucopolysaccharidosis type I, is a disease caused by accumulation of dermatan sulfate or the like in cells due to deficiency of α-L-iduronidase activity in the lysosome. Hurler syndrome patients may have an accompanying central nervous system disorder. The hIDUA bound to the anti-hTfR antibody can be used as a therapeutic agent for central nervous system disorders accompanying the Hurler syndrome.

In the present invention, though the term "human IDUA" or "hIDUA" refers, in particular, to the hIDUA having the same amino acid sequence as the natural-type hIDUA, it also includes those amino acid sequences produced by introducing a mutation, such as substitution, deletion, addition and the like, into the amino acid sequence of the natural-type hIDUA, insofar as they have the hIDUA activity. When replacing one or more of the amino acids of the amino acid sequence of hIDUA with other amino acids, the number of amino acids to be replaced is preferably 1 to 10, more preferably 1 to 5, still more preferably 1 to 3, even more preferably 1 or 2. When deleting one or more amino acids of the amino acid sequence of hIDUA, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hIDUA, they may be added, inside, or on the N-terminal side or the C-terminal side of, the amino acid sequence of hIDUA, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hIDUA has a homology of preferably not lower than 80%, more preferably not lower than 90%, still more preferably not lower than 95% to the amino acid sequence of the original hIDUA.

The statement that hIDUA has the hIDUA activity herein means that the hIDUA fused to anti-hTfR antibody has an activity not lower than 3% of the activity that the natural-type hIDUA intrinsically has. However, the activity is preferably not lower than 10%, more preferably not lower than 20%, still more preferably not lower than 50%, even more preferably not lower than 80% of the activity that the natural-type hIDUA intrinsically has. The same also applies if the hIDUA fused to the anti-hTfR antibody is mutated.

The fusion protein between the anti-hTfR antibody and the hIDUA can be produced by, for example, transforming host cells such as mammalian cells, with an expression vector having an incorporated DNA segment encoding the amino acid sequence set forth as SEQ ID NO: 90 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for Hurler syndrome, in particular, a therapeutic agent for central nervous system disorders accompanying the Hurler syndrome. The fusion protein thus obtained is a fusion protein between the humanized anti-hTfR antibody of IgG4 type and the hIDUA.

Besides, in the case where the anti-hTfR antibody or hIDUA is mutated by adding one or more amino acids to them on the C-terminus or the N-terminus thereof, if the added amino acids are positioned between the anti-hTfR antibody and the hIDUA, the added amino acids constitute part of a linker.

The natural-type human palmitoyl protein thioesterase 1 (hPPT-1) is a type of the lysosomal enzyme consisting of the amino acid sequence set forth as SEQ ID NO: 77.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hPPT-1. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hPPT-1 by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The neuronal ceroid lipofuscinosis (including Santavuori-Haltia disease) is a disease caused by accumulation of ceroid lipofuscin in cells due to deficiency of palmitoyl protein thioesterase 1 activity in lysosome. Neuronal ceroid lipofuscinosis patients may have an accompanying central nervous system disorder. The hPPT-1 bound to the anti-hTfR antibody can be used as a therapeutic agent for central nervous system disorders accompanying the neuronal ceroid lipofuscinosis.

In the present invention, though the term "human PPT-1" or "hPPT-1" refers, in particular, to the hPPT-1 having the same amino acid sequence as the natural-type hPPT-1, it also includes those amino acid sequences produced by introducing a mutation, such as substitution, deletion, addition and the like, into the amino acid sequence of the natural-type hPPT-1, insofar as they have the hPPT-1 activity. When replacing one or more of the amino acids of the amino acid sequence of hPPT-1 with other amino acids, the number of amino acids to be replaced is preferably 1 to 10, more preferably 1 to 5, still more preferably 1 to 3, even more preferably 1 or 2. When deleting one or more amino acids of the amino acid sequence of hPPT-1, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hPPT-1, they may be added, inside, or on the N-terminal side or the C-terminal side of, the amino acid sequence of hPPT-1, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hPPT-1 has a homology of preferably not lower than 80%, more preferably not lower than 90%, still more preferably not lower than 95% to the amino acid sequence of the original hPPT-1.

The statement that hPPT-1 has the hPPT-1 activity herein means that the hPPT-1 fused to anti-hTfR antibody has an activity not lower than 3% of the activity that the natural-type hPPT-1 intrinsically has. However, the activity is preferably not lower than 10%, more preferably not lower than 20%, still more preferably not lower than 50%, even more preferably not lower than 80% of the activity that the natural-type hPPT-1 intrinsically has. The same also applies if the hPPT-1 fused to the anti-hTfR antibody is mutated.

The fusion protein between the anti-hTfR antibody and the hPPT-1 can be produced by, for example, transforming host cells such as mammalian cells, with an expression vector having an incorporated DNA segment encoding the amino acid sequence set forth as SEQ ID NO: 100 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for neuronal ceroid lipofuscinosis, in particular, a therapeutic agent for central nervous system disorders accompanying the neuronal ceroid lipofuscinosis. The fusion protein thus obtained is a fusion protein between the humanized anti-hTfR antibody of IgG4 type and the hPPT-1.

Besides, in the case where the anti-hTfR antibody or hPPT-1 is mutated by adding one or more amino acids to them on the C-terminus or the N-terminus thereof, if the added amino acids are positioned between the anti-hTfR antibody and the hPPT-1, the added amino acids constitute part of a linker.

The natural-type human acidic sphingomyelinase (hASM) is a type of the lysosomal enzyme consisting of the amino acid sequence set forth as SEQ ID NO: 78.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hASM. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hASM by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The human acidic sphingomyelinase (hASM) is a lysosomal enzyme hydrolyzing sphingomyelin into choline phosphate and ceramide. The Niemann-Pick disease is classified into A to F types according to a difference in cause and condition of the disease. Among them, types A and B are caused by genetic deficiency of acidic sphingomyelinase (ASM). The Niemann-Pick disease is a disease caused by accumulation of sphingomyelin in cells due to deficiency of acidic sphingomyelinase activity in lysosome. Niemann-Pick disease patients may have an accompanying central nervous system disorder. The hASM bound to the anti-hTfR antibody can be used as a therapeutic agent for central nervous system disorders accompanying the Niemann-Pick disease.

In the present invention, though the term "human ASM" or "hASM" refers, in particular, to the hASM having the same amino acid sequence as the natural-type hASM, it also includes those amino acid sequences produced by introducing a mutation, such as substitution, deletion, addition and the like, into the amino acid sequence of the natural-type hASM, insofar as they have the hASM activity. When replacing one or more of the amino acids of the amino acid sequence of hASM with other amino acids, the number of amino acids to be replaced is preferably 1 to 10, more preferably 1 to 5, still more preferably 1 to 3, even more preferably 1 or 2. When deleting one or more amino acids of the amino acid sequence of hASM, the number of amino acids to be deleted is 1 to 10, more preferably 1 to 5, still more preferably 1 to 3, even more preferably 1 or 2. It is also possible to introduce a combined mutation of such substitution and deletion of amino acids. When adding one or more amino acids to hASM, they may be added, inside, or on the N-terminal side or the C-terminal side of, the amino acid sequence of hASM, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hASM has a homology of preferably not lower than 80%, more preferably not lower than 90%, still more preferably not lower than 95% to the amino acid sequence of the original hASM.

The statement that hASM has the hASM activity herein means that the hASM fused to anti-hTfR antibody has an activity not lower than 3% of the activity that the natural-type hASM intrinsically has. However, the activity is preferably not lower than 10%, more preferably not lower than 20%, still more preferably not lower than 50%, even more preferably not lower than 80% of the activity that the natural-type hASM intrinsically has. The same also applies if the hASM fused to the anti-hTfR antibody is mutated.

The fusion protein between the anti-hTfR antibody and the hASM can be produced by, for example, transforming host cells such as mammalian cells, with an expression vector having an incorporated DNA segment encoding the amino acid sequence set forth as SEQ ID NO: 106 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for Niemann-Pick disease, in particular, a therapeutic agent for central nervous system disorders accompanying the Niemann-Pick disease. The fusion protein thus obtained is a fusion protein between the humanized anti-hTfR antibody of IgG4 type and the hASM.

Besides, in the case where the anti-hTfR antibody or hASM is mutated by adding one or more amino acids to them on the C-terminus or the N-terminus thereof, if the added amino acids are positioned between the anti-hTfR antibody and the hASM, the added amino acids constitute part of a linker.

The natural-type human arylsulfatase A (hARSA) is a type of the lysosomal enzyme consisting of the amino acid sequence set forth as SEQ ID NO: 79.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hARSA. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hARSA by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The metachromatic white matter degeneration (metachromatic leukodystrophy) is a disease caused by accumulation of sulfatide or the like in cells due to deficiency of arylsulfatase A activity in lysosome. Metachromatic white matter degeneration patients may have an accompanying central nervous system disorder. The hARSA bound to the anti-hTfR antibody can be used as a therapeutic agent for central nervous system disorders accompanying the metachromatic white matter degeneration.

In the present invention, though the term "human ARSA" or "hARSA" refers, in particular, to the hARSA having the same amino acid sequence as the natural-type hARSA, it also includes those amino acid sequences produced by introducing a mutation, such as substitution, deletion, addition and the like, into the amino acid sequence of the natural-type hARSA, insofar as they have the hARSA activity. When replacing one or more of the amino acids of the amino acid sequence of hARSA with other amino acids, the number of amino acids to be replaced is preferably 1 to 10, more preferably 1 to 5, still more preferably 1 to 3, even more preferably 1 or 2. When deleting one or more amino acids of the amino acid sequence of hARSA, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hARSA, they may be added, inside, or on the N-terminal side or the C-terminal side of, the amino acid sequence of hARSA, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hARSA has a homology of preferably not lower than 80%, more preferably not lower than 90%, still more preferably not lower than 95% to the amino acid sequence of the original hARSA.

The statement that hARSA has the hARSA activity herein means that the hARSA fused to anti-hTfR antibody has an activity not lower than 3% of the activity that the natural-type hARSA intrinsically has. However, the activity is preferably not lower than 10%, more preferably not lower than 20%, still more preferably not lower than 50%, even more preferably not lower than 80% of the activity that the natural-type hARSA intrinsically has. The same also applies if the hARSA fused to the anti-hTfR antibody is mutated.

The fusion protein between the anti-hTfR antibody and the hARSA can be produced by, for example, transforming host cells such as mammalian cells, with an expression vector having an incorporated DNA segment encoding the amino acid sequence set forth as SEQ ID NO: 115 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for metachromatic white matter degeneration, in particular, a therapeutic agent for central nervous system disorders accompanying the metachromatic white matter degeneration. The fusion protein thus obtained is a fusion protein between the humanized anti-hTfR antibody of IgG4 type and the hARSA.

Besides, in the case where the anti-hTfR antibody or hARSA is mutated by adding one or more amino acids to them on the C-terminus or the N-terminus thereof, if the added amino acids are positioned between the anti-hTfR antibody and the hARSA, the added amino acids constitute part of a linker.

The natural-type human heparan N-sulfatase (hSGSH) is a type of the lysosomal enzyme consisting of the amino acid sequence set forth as SEQ ID NO: 80.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hSGSH. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hSGSH by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The Sanfilippo syndrome, which is also referred to as mucopolysaccharidosis type II (MPS type III), is a disease caused by accumulation of heparan sulfate in cells due to deficiency of heparan N-sulfatase activity in lysosome. It is to be noted that the Sanfilippo syndrome may be caused by deficiency of other enzymes such as α-N-acetylglucosaminidase. Sanfilippo syndrome patients may have an accompanying central nervous system disorder. The hSGSH bound to the anti-hTfR antibody can be used as a therapeutic agent for central nervous system disorders accompanying the Sanfilippo syndrome.

In the present invention, though the term "human SGSH" or "hSGSH" refers, in particular, to the hSGSH having the same amino acid sequence as the natural-type hSGSH, it also includes those amino acid sequences produced by introducing a mutation, such as substitution, deletion, addition and the like, into the amino acid sequence of the natural-type hSGSH, insofar as they have the hSGSH activity. When replacing one or more of the amino acids of the amino acid sequence of hSGSH with other amino acids, the number of amino acids to be replaced is preferably 1 to 10, more preferably 1 to 5, still more preferably 1 to 3, even more preferably 1 or 2. When deleting one or more amino acids of the amino acid sequence of hSGSH, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hSGSH, they may be added, inside, or on the N-terminal side or the C-terminal side of, the amino acid sequence of hSGSH, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hSGSH has a homology of preferably not lower than 80%, more preferably not lower than 90%, still more preferably not lower than 95% to the amino acid sequence of the original hSGSH.

The statement that hSGSH has the hSGSH activity herein means that the hSGSH fused to anti-hTfR antibody has an activity not lower than 3% of the activity that the natural-type hSGSH intrinsically has. However, the activity is preferably not lower than 10%, more preferably not lower than 20%, still more preferably not lower than 50%, even more preferably not lower than 80% of the activity that the natural-type hSGSH intrinsically has. The same also applies if the hSGSH fused to the anti-hTfR antibody is mutated.

The fusion protein between the anti-hTfR antibody and the hSGSH can be produced by, for example, transforming host cells such as mammalian cells, with an expression vector having an incorporated DNA segment encoding the amino acid sequence set forth as SEQ ID NO: 124 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for Sanfilippo syndrome, in particular, a therapeutic agent for central nervous system disorders accompanying the Sanfilippo syndrome. The fusion protein thus obtained is a fusion protein between the humanized anti-hTfR antibody of IgG4 type and the hSGSH.

Besides, in the case where the anti-hTfR antibody or hSGSH is mutated by adding one or more amino acids to them on the C-terminus or the N-terminus thereof, if the added amino acids are positioned between the anti-hTfR antibody and the hSGSH, the added amino acids constitute part of a linker.

The natural-type human glucocerebrosidase (hGBA) is a type of the lysosomal enzyme consisting of the amino acid sequence set forth as SEQ ID NO: 81.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hGBA. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hGBA by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The human glucocerebrosidase (hGBA) is a lysosomal enzyme hydrolyzing glycolipid glucocerebroside (glucosylceramide). The Gaucher disease is a disease caused by accumulation of glucocerebroside in cells due to deficiency of glucocerebrosidase activity in lysosome. Gaucher disease patients may have an accompanying central nervous system disorder. The hGBA bound to the anti-hTfR antibody can be used as a therapeutic agent for central nervous system disorders accompanying the Gaucher disease.

In the present invention, though the term "human GBA" or "hGBA" refers, in particular, to the hGBA having the same amino acid sequence as the natural-type hGBA, it also includes those amino acid sequences produced by introducing a mutation, such as substitution, deletion, addition and the like, into the amino acid sequence of the natural-type hGBA, insofar as they have the hGBA activity. When replacing one or more of the amino acids of the amino acid sequence of hGBA with other amino acids, the number of amino acids to be replaced is preferably 1 to 10, more preferably 1 to 5, still more preferably 1 to 3, even more preferably 1 or 2. When deleting one or more amino acids of the amino acid sequence of hGBA, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hGBA, they may be added, inside, or on the N-terminal side or the C-terminal side of, the amino acid sequence of hGBA, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hGBA has a homology of preferably not lower than 80%, more preferably not lower than 90%, still more preferably not lower than 95% to the amino acid sequence of the original hGBA.

The statement that hGBA has the hGBA activity herein means that the hGBA fused to anti-hTfR antibody has an activity not lower than 3% of the activity that the natural-type hGBA intrinsically has. However, the activity is preferably not lower than 10%, more preferably not lower than 20%, still more preferably not lower than 50%, even more preferably not lower than 80% of the activity that the natural-type hGBA intrinsically has. The same also applies if the hGBA fused to the anti-hTfR antibody is mutated.

The fusion protein between the anti-hTfR antibody and the hGBA can be produced by, for example, transforming host cells such as mammalian cells, with an expression vector having an incorporated DNA segment encoding the amino acid sequence set forth as SEQ ID NO: 130 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for Gaucher disease, in particular, a therapeutic agent for central nervous system disorders accompanying the Gaucher disease. The fusion protein thus obtained is a fusion protein between the humanized anti-hTfR antibody of IgG4 type and the hGBA.

Besides, in the case where the anti-hTfR antibody or hGBA is mutated by adding one or more amino acids to them on the C-terminus or the N-terminus thereof, if the added amino acids are positioned between the anti-hTfR antibody and the hGBA, the added amino acids constitute part of a linker.

The natural-type human tripeptidyl peptidase-1 (hTPP-1) is a type of the lysosomal enzyme consisting of the amino acid sequence set forth as SEQ ID NO: 82.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hTPP-1. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hTPP-1 by a peptide bond. An anti-hTfR antibody of IgG1 type has the amino acid sequence set forth as SE ID NO: 66, and an anti-hTfR antibody of IgG4 type has the amino acid sequence set forth as SEQ ID NO: 68.

The neuronal ceroid lipofuscinosis (including Santavuori-Haltia disease) is a disease caused by accumulation of lipofuscin in cells due to deficiency of tripeptidyl peptidase 1 activity in liposome. Neuronal ceroid lipofuscinosis patients may have an accompanying central nervous system disorder. The hTPP-1 bound to the anti-hTfR antibody can be used as a therapeutic agent for central nervous system disorders accompanying the neuronal ceroid lipofuscinosis.

In the present invention, though the term "human TPP-1" or "hTPP-1" refers, in particular, to the hTPP-1 having the same amino acid sequence as the natural-type hTPP-1, it also includes those amino acid sequences produced by introducing a mutation, such as substitution, deletion, addition and the like, into the amino acid sequence of the natural-type hTPP-1, insofar as they have the hTPP-1 activity. When replacing one or more of the amino acids of the amino acid sequence of hTPP-1 with other amino acids, the number of amino acids to be replaced is preferably 1 to 10, more preferably 1 to 5, still more preferably 1 to 3, even more preferably 1 or 2. When deleting one or more amino acids of the amino acid sequence of hTPP-1, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hTPP-1, they may be added, inside, or on the N-terminal side or the C-terminal side of, the amino acid sequence of hTPP-1, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hTPP-1 has a homology of preferably not lower than 80%, more preferably not lower than 90%, still more preferably not lower than 95% to the amino acid sequence of the original hTPP-1.

The statement that hTPP-1 has the hTPP-1 activity herein means that the hTPP-1 fused to anti-hTfR antibody has an activity not lower than 3% of the activity that the natural-type hTPP-1 intrinsically has. However, the activity is preferably not lower than 10%, more preferably not lower than 20%, still more preferably not lower than 50%, even more preferably not lower than 80% of the activity that the natural-type hTPP-1 intrinsically has. The same also applies if the hTPP-1 fused to the anti-hTfR antibody is mutated.

The fusion protein between the anti-hTfR antibody and the hTPP-1 can be produced by, for example, transforming host cells such as mammalian cells, with an expression vector having an incorporated DNA segment encoding the amino acid sequence set forth as SEQ ID NO: 136 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for neuronal ceroid lipofuscinosis, in particular, a therapeutic agent for central nervous system disorders accompanying the neuronal ceroid lipofuscinosis. The fusion protein thus obtained is a fusion protein between the humanized anti-hTfR antibody of IgG4 type and the hTPP-1.

Besides, in the case where the anti-hTfR antibody or hTPP-1 is mutated by adding one or more amino acids to them on the C-terminus or the N-terminus thereof, if the added amino acids are positioned between the anti-hTfR antibody and the hTPP-1, the added amino acids constitute part of a linker.

The natural-type human α-N-acetylglucosaminidase (hNAGLU) is a type of the lysosomal enzyme consisting of the amino acid sequence set forth as SEQ ID NO: 83.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hNAGLU. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hNAGLU by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The Sanfilippo syndrome is a disease caused by accumulation of heparan sulfate in cells due to deficiency of α-N-acetylglucosaminidase activity in lysosome. Sanfilippo syndrome patients may have an accompanying central nervous system disorder. The hNAGLU bound to the anti-hTfR antibody can be used as a therapeutic agent for central nervous system disorders accompanying the Sanfilippo syndrome.

In the present invention, though the term "human NAGLU" or "hNAGLU" refers, in particular, to the hNAGLU having the same amino acid sequence as the natural-type hNAGLU, it also includes those amino acid sequences produced by introducing a mutation, such as substitution, deletion, addition and the like, into the amino acid sequence of the natural-type hNAGLU, insofar as they have the hNAGLU activity. When replacing one or more of the amino acids of the amino acid sequence of hNAGLU with other amino acids, the number of amino acids to be replaced is preferably 1 to 10, more preferably 1 to 5, still more preferably 1 to 3, even more preferably 1 or 2. When deleting one or more amino acids of the amino acid sequence of hNAGLU, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hNAGLU, they may be added, inside, or on the N-terminal side or the C-terminal side of, the amino acid sequence of hNAGLU, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hNAGLU has a homology of preferably not lower than 80%, more preferably not lower than 90%, still more preferably not lower than 95% to the amino acid sequence of the original hNAGLU.

The statement that hNAGLU has the hNAGLU activity herein means that the hNAGLU fused to anti-hTfR antibody has an activity not lower than 3% of the activity that the natural-type hNAGLU intrinsically has. However, the activity is preferably not lower than 10%, more preferably not lower than 20%, still more preferably not lower than 50%, even more preferably not lower than 80% of the activity that the natural-type hNAGLU intrinsically has. The same also applies if the hNAGLU fused to the anti-hTfR antibody is mutated.

The fusion protein between the anti-hTfR antibody and the hNAGLU can be produced by, for example, transforming host cells such as mammalian cells, with an expression vector having an incorporated DNA segment encoding the amino acid sequence set forth as SEQ ID NO: 142 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for Sanfilippo syndrome, in particular, a therapeutic agent for central nervous system disorders accompanying the Sanfilippo syndrome. The fusion protein thus obtained is a fusion protein between the humanized anti-hTfR antibody of IgG4 type and the hNAGLU.

Besides, in the case where the anti-hTfR antibody or hNAGLU is mutated by adding one or more amino acids to them on the C-terminus or the N-terminus thereof, if the added amino acids are positioned between the anti-hTfR antibody and the hNAGLU, the added amino acids constitute part of a linker.

The natural-type human β-glucuronidase (hGUSB) is a type of the lysosomal enzyme consisting of the amino acid sequence set forth as SEQ ID NO: 84.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hGUSB. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hGUSB by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The Sly syndrome, which is also referred to as mucopolysaccharidosis type VII (MPS type VII), is a disease caused by accumulation of mucopolysaccharides in cells due to deficiency of β-glucuronidase activity in lysosome. Sly syndrome patients may have an accompanying central nervous system disorder. The hGUSB bound to the anti-hTfR antibody can be used as a therapeutic agent for central nervous system disorders accompanying the Sly syndrome.

In the present invention, though the term "human GUSB" or "hGUSB" refers, in particular, to the hGUSB having the same amino acid sequence as the natural-type hGUSB, it also includes those amino acid sequences produced by introducing a mutation, such as substitution, deletion, addition and the like, into the amino acid sequence of the natural-type hGUSB, insofar as they have the hGUSB activity. When replacing one or more of the amino acids of the amino acid sequence of hGUSB with other amino acids, the number of amino acids to be replaced is preferably 1 to 10, more preferably 1 to 5, still more preferably 1 to 3, even more preferably 1 or 2. When deleting one or more amino acids of the amino acid sequence of hGUSB, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hGUSB, they may be added, inside, or on the N-terminal side or the C-terminal side of, the amino acid sequence of hGUSB, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hGUSB has a homology of preferably not lower than 80%, more preferably not lower than 90%, still more preferably not lower than 95% to the amino acid sequence of the original hGUSB.

The statement that hGUSB has the hGUSB activity herein means that the hGUSB fused to anti-hTfR antibody has an activity not lower than 3% of the activity that the natural-type hGUSB intrinsically has. However, the activity is preferably not lower than 10%, more preferably not lower than 20%, still more preferably not lower than 50%, even more preferably not lower than 80% of the activity that the natural-type hGUSB intrinsically has. The same also applies if the hGUSB fused to the anti-hTfR antibody is mutated.

The fusion protein between the anti-hTfR antibody and the hGUSB can be produced by, for example, transforming host cells such as mammalian cells, with an expression vector having an incorporated DNA segment encoding the amino acid sequence set forth as SEQ ID NO: 150 and an expression vector having an incorporated DNA segment encoding an anti-hTfR antibody light chain having the amino acid sequence set forth as SEQ ID NO: 23, and then culturing the host cells. The fusion protein thus obtained is a fusion protein between the humanized anti-hTfR antibody of IgG4 type and the hGUSB. The fusion protein thus produced can be used as a therapeutic agent for Sly syndrome, in particular, a therapeutic agent for central nervous system disorders accompanying the Sly syndrome.

Besides, in the case where the anti-hTfR antibody or hGUSB is mutated by adding one or more amino acids to them on the C-terminus or the N-terminus thereof, if the added amino acids are positioned between the anti-hTfR antibody and the hGUSB, the added amino acids constitute part of a linker.

The natural-type human galactosylceramidase (hGALC) is a type of the lysosomal enzyme consisting of the amino acid sequence set forth as SEQ ID NO: 85.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hGALC. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hGALC by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The Krabbe disease is a disease caused by deficiency of galactosylceramidase activity. Krabbe disease patients may have an accompanying central nervous system disorder. The hGALC bound to the anti-hTfR antibody can be used as a therapeutic agent for central nervous system disorders accompanying the Krabbe disease.

In the present invention, though the term "human GALC" or "hGALC" refers, in particular, to the hGALC having the same amino acid sequence as the natural-type hGALC, it also includes those amino acid sequences produced by introducing a mutation, such as substitution, deletion, addition and the like, into the amino acid sequence of the natural-type hGALC, insofar as they have the hGALC activity. When replacing one or more of the amino acids of the amino acid sequence of hGALC with other amino acids, the number of amino acids to be replaced is preferably 1 to 10, more preferably 1 to 5, still more preferably 1 to 3, even more preferably 1 or 2. When deleting one or more amino acids of the amino acid sequence of hGALC, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hGALC, they may be added, inside, or on the N-terminal side or the C-terminal side of, the amino acid sequence of hGALC, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hGALC has a homology of preferably not lower than 80%, more preferably not lower than 90%, still more preferably not lower than 95% to the amino acid sequence of the original hGALC.

The statement that hGALC has the hGALC activity herein means that the hGALC fused to anti-hTfR antibody has an activity not lower than 3% of the activity that the natural-type hGALC intrinsically has. However, the activity is preferably not lower than 10%, more preferably not lower than 20%, still more preferably not lower than 50%, even more preferably not lower than 80% of the activity that the natural-type hGALC intrinsically has. The same also applies if the hGALC fused to the anti-hTfR antibody is mutated.

The fusion protein between the anti-hTfR antibody and the hGALC can be produced by, for example, transforming host cells such as mammalian cells, with an expression vector having an incorporated DNA segment encoding the amino acid sequence set forth as SEQ ID NO: 158 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for Krabbe disease, in particular, a therapeutic agent for central nervous system disorders accompanying the Krabbe disease. The fusion protein thus obtained is a fusion protein between the humanized anti-hTfR antibody of IgG4 type and the hGALC.

Besides, in the case where the anti-hTfR antibody or hGALC is mutated by adding one or more amino acids to them on the C-terminus or the N-terminus thereof, if the added amino acids are positioned between the anti-hTfR antibody and the hGALC, the added amino acids constitute part of a linker.

The natural-type human acidic ceramidase (hAC) is a type of the lysosomal enzyme consisting of the amino acid sequence set forth as SEQ ID NO: 86.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hAC. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hAC by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The Farber disease is a disease caused by accumulation of ceramide in cells due to deficiency of acidic ceramidase activity in lysosome. Farber disease patients may have an accompanying central nervous system disorder. The hAC bound to the anti-hTfR antibody can be used as a therapeutic agent for central nervous system disorders accompanying the Farber disease.

In the present invention, though the term "human AC" or "hAC" refers, in particular, to the hAC having the same amino acid sequence as the natural-type hAC, it also includes those amino acid sequences produced by introducing a mutation, such as substitution, deletion, addition and the like, into the amino acid sequence of the natural-type hAC, insofar as they have the hAC activity. When replacing one or more of the amino acids of the amino acid sequence of hAC with other amino acids, the number of amino acids to be replaced is preferably 1 to 10, more preferably 1 to 5, still more preferably 1 to 3, even more preferably 1 or 2. When deleting one or more amino acids of the amino acid sequence of hAC, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hAC, they may be added, inside, or on the N-terminal side or the C-terminal side of, the amino acid sequence of hAC, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hAC has a homology of preferably not lower than 80%, more preferably not lower than 90%, still more preferably not lower than 95% to the amino acid sequence of the original hAC.

The statement that hAC has the hAC activity herein means that the hAC fused to anti-hTfR antibody has an activity not lower than 3% of the activity that the natural-type hAC intrinsically has. However, the activity is preferably not lower than 10%, more preferably not lower than 20%, still more preferably not lower than 50%, even more preferably not lower than 80% of the activity that the natural-type hAC intrinsically has. The same also applies if the hAC fused to the anti-hTfR antibody is mutated.

The fusion protein between the anti-hTfR antibody and the hAC can be produced by, for example, transforming host cells such as mammalian cells, with an expression vector having an incorporated DNA segment encoding the amino acid sequence set forth as SEQ ID NO: 166 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for Farber disease, in particular, a therapeutic agent for central nervous system disorders accompanying the Farber disease. The fusion protein thus obtained is a fusion protein between the humanized anti-hTfR antibody of IgG4 type and the hAC.

Besides, in the case where the anti-hTfR antibody or hAC is mutated by adding one or more amino acids to them on the C-terminus or the N-terminus thereof, if the added amino acids are positioned between the anti-hTfR antibody and the hAC, the added amino acids constitute part of a linker.

The natural-type human α-L-fucosidase (hFUCA1) is a type of the lysosomal enzyme consisting of the amino acid sequence set forth as SEQ ID NO: 87.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hFUCA1. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hFUCA1 by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The fucosidosis is a disease caused by accumulation of fucose-containing oligosaccharides in cells due to deficiency of α-L-fucosidase activity in lysosome. Fucosidosis patients may have an accompanying central nervous system disorder. The hFUCA1 bound to the anti-hTfR antibody can be used as a therapeutic agent for central nervous system disorders accompanying the fucosidosis.

In the present invention, though the term "human FUCA1" or "hFUCA1" refers, in particular, to the hFUCA1 having the same amino acid sequence as the natural-type hFUCA1, it also includes those amino acid sequences produced by introducing a mutation, such as substitution, deletion, addition and the like, into the amino acid sequence of the natural-type hFUCA1, insofar as they have the hFUCA1 activity. When replacing one or more of the amino acids of the amino acid sequence of hFUCA1 with other amino acids, the number of amino acids to be replaced is preferably 1 to 10, more preferably 1 to 5, still more preferably 1 to 3, even more preferably 1 or 2. When deleting one or more amino acids of the amino acid sequence of hFUCA1, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hFUCA1, they may be added, inside, or on the N-terminal side or the C-terminal side of, the amino acid sequence of hFUCA1, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hFUCA1 has a homology of preferably not lower than 80%, more preferably not lower than 90%, still more preferably not lower than 95% to the amino acid sequence of the original hFUCA1.

The statement that hFUCA1 has the hFUCA1 activity herein means that the hFUCA1 fused to anti-hTfR antibody has an activity not lower than 3% of the activity that the natural-type hFUCA1 intrinsically has. However, the activity is preferably not lower than 10%, more preferably not lower than 20%, still more preferably not lower than 50%, even more preferably not lower than 80% of the activity that the natural-type hFUCA1 intrinsically has. The same also applies if the hFUCA1 fused to the anti-hTfR antibody is mutated.

The fusion protein between the anti-hTfR antibody and the hFUCA1 can be produced by, for example, transforming host cells such as mammalian cells, with an expression vector having an incorporated DNA segment encoding the amino acid sequence set forth as SEQ ID NO: 174 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for fucosidosis, in particular, a therapeutic agent for central nervous system disorders accompanying the fucosidosis. The fusion protein thus obtained is a fusion protein between the humanized anti-hTfR antibody of IgG4 type and the hFUCA1.

Besides, in the case where the anti-hTfR antibody or hFUCA1 is mutated by adding one or more amino acids to them on the C-terminus or the N-terminus thereof, if the added amino acids are positioned between the anti-hTfR antibody and the hFUCA1, the added amino acids constitute part of a linker.

The natural-type human α-mannosidase (hLAMAN) is a type of the lysosomal enzyme consisting of the amino acid sequence set forth as SEQ ID NO: 88.

A specific example of the fusion protein between the anti-hTfR antibody and a different protein (A) in the present invention is a type in which the anti-hTfR antibody heavy chain is fused, on the C-terminus thereof and via the amino acid sequence Gly-Ser as a linker sequence, to the natural-type hLAMAN. Examples of such fusion proteins include one whose light chain consists of the amino acid sequence set forth as SEQ ID NO: 23 and whose heavy chain consists of the amino acid sequence set forth as SEQ ID NO: 66 or 68, and is bound, on the C-terminal side and via the linker sequence Gly-Ser, to the hLAMAN by a peptide bond. An anti-hTfR antibody of IgG1 type has the amino acid sequence set forth as SEQ ID NO: 66, and an anti-hTfR antibody of IgG4 type has the amino acid sequence set forth as SEQ ID NO: 68.

The human α-mannosidase (hLAMAN) is a lysosomal enzyme hydrolyzing α-type mannose. The α-mannosidosis is a disease caused by accumulation of mannose-containing oligosaccharides in cells due to deficiency of α-mannosidase activity in lysosome. α-Mannosidosis patents may have an accompanying central nervous disorder. The hLAMAN bound to the anti-hTfR antibody can be used as a therapeutic agent for central nervous disorders accompanying the α-mannosidosis.

In the present invention, though the term "human LAMAN" or "hLAMAN" refers, in particular, to the hLAMAN having the same amino acid sequence as the natural-type hLAMAN, it also includes those amino acid sequences produced by introducing a mutation, such as substitution, deletion, addition and the like, into the amino acid sequence of the natural-type hLAMAN, insofar as they have the hLAMAN activity. When replacing one or more of the amino acids of the amino acid sequence of hLAMAN with other amino acids, the number of amino acids to be replaced is preferably 1 to 10, more preferably 1 to 5, still more preferably 1 to 3, even more preferably 1 or 2. When deleting one or more amino acids of the amino acid sequence of hLAMAN, the number of amino acids to be deleted is preferably 1 to 10, more preferably 1 to 5, still more preferably 1 to 3, even more preferably 1 or 2. It is also possible to introduce a combined mutation of such substitution and deletion of amino acids. When adding one or more amino acids to hLAMAN, they may be added, inside, or on the N-terminal side or the C-terminal side of, the amino acid sequence of hLAMAN, and the number of amino acids to be added is preferably 1 to 10, more preferably 1 to 5, still more preferably 1 to 3, even more preferably 1 or 2. It is also possible to introduce a combined mutation of such addition, substitution, and deletion of the amino acid. The amino acid sequence of the mutated hLAMAN has a homology of preferably not lower than 80%, more preferably not lower than 90%, still more preferably not lower than 95% to the amino acid sequence of the original hLAMAN.

The statement that hLAMAN has the hLAMAN activity herein means that the hLAMAN fused to anti-hTfR antibody has an activity not lower than 3% of the activity that the natural-type hLAMAN intrinsically has. However, the activity is preferably not lower than 10%, more preferably not lower than 20%, still more preferably not lower than 50%, even more preferably not lower than 80% of the activity that the natural-type hLAMAN intrinsically has. The same also applies if the hLAMAN fused to the anti-hTfR antibody is mutated.

The fusion protein between the anti-hTfR antibody and the hLAMAN can be produced by, for example, transforming host cells such as mammalian cells, with an expression vector having an incorporated DNA segment encoding the amino acid sequence set forth as SEQ ID NO: 182 and an expression vector having an incorporated DNA segment encoding an anti-hTfR antibody light chain having the amino acid sequence set forth as SEQ ID NO: 23, and then culturing the host cells. The fusion protein thus produced can be used as a therapeutic agent for α-mannosidosis, in particular, a therapeutic agent for central nervous system disorders accompanying the α-mannosidosis. The fusion protein thus obtained is a fusion protein between the humanized anti-hTfR antibody of IgG4 type and the hLAMAN.

Besides, in the case where the anti-hTfR antibody or hLAMAN is mutated by adding one or more amino acids to them on the C-terminus or the N-terminus thereof, if the added amino acids are positioned between the anti-hTfR antibody and the hLAMAN, the added amino acids constitute part of a linker.

As examples of fusion proteins between the anti-hTfR antibody and a different protein (A), fusion proteins having hGAA, hI2S, hIDUA, hPPT-1, hASM, hARSA, hSGSH, hGBA, hTTP-1, hNAGLU, hGUSB, hAC, hFUcal and hLAMAN, respectively, as the different protein (A) are described above, but there is no particular limitation as to the amino acid sequences of the CDRs of the anti-hTfR antibody heavy chain and light chain in preferred embodiments of fusion proteins between the anti-hTfR antibody and such a different protein (A) insofar as the antibody has a specific affinity to hTfR.

However, anti-TfR antibodies used herein are those whose dissociation constant is as follows, in particular, as measured by the method described in Example 7:

dissociation constant with human TfR: preferably not greater than $1\times10^{-10}$ M, more preferably not greater than $1\times10^{-11}$ M, still more preferably not greater than $5\times10^{-12}$ M, even more preferably not greater than $1\times10^{-12}$ M; and dissociation constant with monkey TfR: preferably not greater than $1\times10^{-9}$ M, more preferably not greater than $5\times10^{-10}$ M, still more preferably not greater than $1\times10^{-10}$ M, for example not greater than $7.5\times10^{-11}$ M.

For example, the dissociation constants with human TfR and monkey TfR are not greater than $1\times10^{-10}$ M and not greater than $1\times10^{-9}$ M, not greater than $1\times10^{-11}$ M and not greater than $5\times10^{-10}$ M, not greater than $5\times10^{-12}$ M and not greater than $1\times10^{-10}$ M, not greater than $5\times10^{-12}$ M and not greater than $7.5\times10^{-11}$ M, not greater than $1\times10^{-12}$ M and not greater than $1\times10^{-10}$ M, or not greater than $1\times10^{-12}$ M and not greater than $7.5\times10^{-11}$ M, respectively. In this context, although there is no particularly definite lower limit on the dissociation constant with human TfR, it can be, for example, $5\times10^{-13}$ M or $1\times10^{-13}$ M. Although there is no particularly definite lower limit on the dissociation constant with monkey TfR, it can be, for example, $1\times10^{-11}$ M or $1\times10^{-12}$ M. The same also applies if the antibody is a single-chain antibody.

It is also possible to link a relatively short peptide chain to the anti-hTfR antibody, in the same manner as in linking a different protein (A) to the anti-hTfR antibody. There is no particular limitation as to a peptide chain to be linked to the anti-hTfR antibody, insofar as the peptide chain has a desired physiological activity. For example, there are peptide chains comprising the amino acid sequence of such a region of various proteins that exhibits a physiological activity. Though there is no particular limitation as to the length of the peptide chain, they are composed of preferably 2-200 amino acids, for example of 5-50 amino acids.

In linking a low-molecular-weight compound to the anti-hTfR antibody, there is no particular limitation as to candidate low-molecular-weight compounds, but they are such low-molecular-weight compound that though needed to get inside the brain and function there, due to their inability to pass through the blood-brain barrier as it is, cannot be expected to function in the brain if simply administered intravenously. Examples of such low-molecular-weight compounds include anticancer drug such as cyclophosphamide, ifosfamide, melphalan, busulfan, thioTEPA, nimustine, ranimustine, dacarbazine, procarbazine, temozolomide, carmustine, streptozocin, bendamustine, cisplatin, carboplatin, oxaliplatin, nedaplatin, 5-fluorouracil, sulfadiazine, sulfamethoxazole, methotrexate, trimethoprim, pyrimethamine, fluorouracil, flucytosine, azathioprine, pentostatin, hydroxyurea, fludarabine, cytarabine, gemcitabine, irinotecan, doxorubicin, etoposide, levofloxacin, ciprofloxacin, vinblastine, vincristine, paclitaxel, docetaxel, Mitomycin C, doxorubicin, epirubicin. Further examples of low-molecular-weight compound to be linked to the anti-hTfR antibody include siRNAs, antisense DNAs, and short peptides.

In linking between the anti-hTfR antibody and a low-molecular-weight compound, either a low-molecular-weight compound may be linked only to one of the light chain and heavy chain, or it may be linked to both the light chain and the heavy chain, respectively. Further, insofar as it has an affinity to hTfR, the anti-hTfR antibody may comprise an amino acid sequence comprising the whole of part of the light chain variable region and/or an amino acid sequence comprising the whole of part of the heavy chain variable region.

Candidates for low-molecular-weight compounds to be fused with the anti-hTfR antibody can generally be those therapeutic agents for diseases such as neurodegenerative diseases such as Alzheimer's disease, Parkinson's disease, Huntington's disease; mental disorders such as schizophrenia, depression; multiple sclerosis; amyotrophic lateral sclerosis; tumor of the central nervous system including brain tumor; lysosomal storage diseases with accompanying encephalopathy; glycogenosis; muscular dystrophy; cerebral ischemia; encephalitis; prion diseases; traumatic disorders of the central nervous system. Further, therapeutic agents for viral and bacterial central nervous system diseases can also be candidates, in general, for low-molecular-weight compounds to be fused with the anti-hTfR antibody. Still further, those pharmaceutical agents which can be used for recovery after brain surgery or spinal surgery can also be candidates, in general, for low-molecular-weight compounds to be fused.

If an anti-hTfR antibody originates from a non-human animal, its administration to human could entail a substantial risk of causing an antigen-antibody interaction, thereby provoking adverse side-effects. By converting them to humanized antibodies, the antigenicity of non-human animal antibodies can be reduced and therefore the provocation of side-effects due to antigen-antibody interaction can be suppressed when administered to a human. Further, it has been reported that according to experiments using monkeys, humanized antibodies are more stable than mouse antibodies in the blood, and it is expected that their therapeutic effect can therefore become longer-lasting accordingly. Provocation of side-effects due to an antigen-antibody interaction can be suppressed also by employing a human antibody as the anti-hTfR antibody.

A detailed explanation will be given below regarding the case where the anti-hTfR antibody is a humanized antibody or human antibody. In human antibody light chain, there are λ and κ chains. The light chain constituting the human antibody may either be λ and κ chain. And in human heavy chain, there are γ, μ, α, σ, and ε chains, which correspond to IgG, IgM, IgA, IgD and IgE, respectively. Though the heavy chain constituting the anti-hTfR antibody may be any of γ, μ, α, σ, and ε chains, preferred is a γ chain. Further, in γ chain of human heavy chain, there are γ1, γ2, γ3 and γ4 chains, which correspond to IgG1, IgG2, IgG3 and IgG4, respectively. Where the heavy chain constituting the anti-hTfR antibody is a γ chain, though the γ chain may be any of γ1, γ2, γ3 and γ4 chains, preferred is a γ1 or γ4 chain. In the case where the anti-hTfR antibody is a humanized antibody or human antibody and IgG, the human antibody light chain may either be λ chain or κ chain, and though the human antibody heavy chain may either be γ1, γ2, γ3 and γ4 chains, preferred is a γ1 or γ4 chain. For example, a preferable embodiment of anti-hTfR antibody includes one whose light chain is a λ chain and heavy chain is a γ1 chain.

In the case where the anti-hTfR antibody is a humanized antibody or a human antibody, the anti-hTfR antibody and a different protein (A) may be bound together by linking the anti-hTfR antibody, at the N-terminus (or the C-terminus) of the heavy chain or light chain, via a linker sequence or directly, to the C-terminus (or the N-terminus), respectively, of the different protein (A), by peptide bonds. When linking the different protein (A) to the anti-hTfR antibody heavy chain on the N-terminal side (or to the C-terminal side) thereof, the C-terminus (or the N-terminus), respectively, of the different protein (A) is linked to the N-terminus (or the C-terminus) of the γ, μ, α, σ or ε chain of anti-hTfR antibody, via a linker sequence or directly, by peptide bonds. When linking the different protein (A) to the anti-hTfR antibody light chain on the N-terminal side (or the C-terminal side) thereof, the C-terminus (or the N-terminus), respectively, of the different protein (A) in linked to the N-terminus (or the C-terminus) of the λ chain and κ chain of anti-hTfR antibody, via a linker sequence or directly, by peptide bonds. However, in the case where the anti-hTfR antibody consists of the Fab region, or of the Fab region and the whole or part of the hinge region (Fab, F(ab')$_2$, and F(ab')), the different protein (A) may be linked at the C-terminus (or the N-terminus) thereof and via a linker sequence or directly, to the N-terminus (or the C-terminus), respectively, of the heavy chain or light chain that constitutes the Fab, F(ab')$_2$ and F(ab'), by peptide bonds.

In a fusion protein produced by linking the different protein (A) to the light chain of the anti-hTfR antibody which is a humanized antibody, or a human antibody, on the C-terminal side or the N-terminal side thereof, the anti-human transferrin receptor antibody comprises an amino acid sequence comprising the whole or part of the light chain variable region and the amino acid sequence comprising the whole or part of the heavy chain variable region. The anti-hTfR antibody light chain and the different protein (A) here may be linked directly or via a linker.

In a fusion protein produced by linking the different protein (A) to the heavy chain of the anti-hTfR antibody which is a humanized antibody, or human antibody, on the C-terminal side or the N-terminal side thereof, the anti-human transferrin receptor antibody comprises an amino acid sequence comprising the whole or part of the light chain variable region and the amino acid sequence comprising the whole or part of the heavy chain variable region. The anti-hTfR antibody heavy chain and the different protein (A) here may be linked directly or via a linker.

When placing a linker sequence between the anti-hTfR antibody or human antibody and a different protein (A), the linker sequence is preferably a peptide chain consisting of 1-50 amino acids, though the number of the amino acids constituting such a linker sequence may be adjusted as desired in accordance with the different protein (A) to be linked to the anti-hTfR antibody, like 1-17, 1-10, 10-40, 20-34, 23-31, 25-29, and so on. While there is no particular limitation as to the specific amino acid sequence of such a linker sequence insofar as the anti-hTfR antibody and the different protein (A) linked by the linker sequence retain their respective functions (affinity to hTfR, and activity or function under a physiological condition), it is preferably composed of glycine or serine, for example, one consisting of a single amino acid either glycine or serine, the amino acid sequence Gly-Ser, the amino acid sequence Gly-Gly-Ser, the amino acid sequence Gly-Gly-Gly-Gly-Ser (SEQ ID NO:3), the amino acid sequence Gly-Gly-Gly-Gly-Gly-Ser (SEQ ID NO:4), the amino acid sequence Ser-Gly-Gly-Gly-Gly (SEQ ID NO:5), or a sequence which includes 1-10 or 2-5 of any of those amino acid sequences consecutively linked. For example, a linker sequence comprising 27 amino acids is preferably used that is composed of the amino acid sequence Gly-Ser followed by consecutively linked five copies of the amino acid sequence Gly-Gly-Gly-Gly-Ser (SEQ ID NO:3). Further, a linker sequence comprising 25 amino acids is also preferably used that is composed of consecutively linked five copies of the amino acid sequence Gly-Gly-Gly-Gly-Ser (SEQ ID NO: 3).

Besides, when stated here that a different protein (A) fused with the anti-hTfR antibody or human antibody retains its activity or function under a physiological condition, or simply, it "retains the activity", it means that in comparison with the intrinsic activity of the natural-type of the different protein (A), not lower than 3% of the activity or function is retained. However, such an activity or function is preferably not lower than 10%, more preferably not lower than 20%, still more preferably not lower than 50%, and even more preferably not lower than 80%, in comparison with the intrinsic activity of the natural-type of the different protein (A). The same also applies where the different protein (A) fused with the anti-hTfR antibody is a mutated one.

A further example of specific embodiments of the fusion protein between a humanized anti-hTfR antibody or human antibody and a different protein (A) of the present invention is one produced by fusing the anti-hTfR antibody heavy chain, on the C-terminal side thereof, with a different protein (A), via a linker sequence consisting of 27 amino acids that is composed of the amino acid sequence Gly-Ser followed by consecutively linked five copies of the amino acid sequence Gly-Gly-Gly-Gly-Ser (SEQ ID NO:3).

In the case where the anti-hTfR antibody is Fab, an example of specific embodiments of fusion proteins between a humanized anti-hTfR antibody or human antibody of the present invention and a different protein (A) is one produced by fusing a different protein (A), on the C-terminal side thereof via a linker sequences, with the region consisting of anti-hTfR antibody heavy chain variable region and its accompanying $C_H1$ region, wherein the linker sequence consists of 25 amino acids that is composed of consecutively linked five copies of the amino acid sequence Gly-Gly-Gly-Gly-Ser (SEQ ID NO:3). Though it is also allowed here that part of the hinge region is also besides the $C_H1$ region, the hinge region does not contain a cysteine residue that would form a disulfide bond between heavy chains.

The specific affinity of the anti-hTfR antibody to hTfR resides mainly in the amino acid sequences of CDRs of the heavy chain and light chain of the anti-hTfR antibody. There is no particular limitation as to the amino acid sequences of those CDRs insofar as the anti-hTfR antibody has a specific affinity to monkey hTfR in addition to hTfR.

However, in the present invention, a humanized anti-hTfR antibody or a human antibody that is an antibody having a relatively high affinity to hTfR and has affinity both to human and monkey TfRs, simultaneously, is one whose dissociation constant with human TfR is preferably not greater than $1 \times 10^{-10}$ M, more preferably not greater than $2.5 \times 10^{-11}$ M, still more preferably not greater than $5 \times 10^{-12}$ M, and even more preferably not greater than $1 \times 10^{-12}$ M, and whose dissociation constant with monkey TfR is preferably not greater than $1 \times 10^{-9}$ M, more preferably not greater than $5 \times 10^{-10}$ M, and still more preferably not greater than $1 \times 10^{-10}$ M, for example, not greater than $7.5 \times 10^{-11}$ M, in particular, as measured by the method described in Example 7.

For example, the dissociation constants with human TfR and monkey TfR are not greater than $1 \times 10^{-10}$ M and not greater than $1 \times 10^{-9}$ M, not greater than $1 \times 10^{-11}$ M and not greater than $5 \times 10^{-10}$ M, not greater than $5 \times 10^{-12}$ M and not greater than $1 \times 10^{-10}$ M, not greater than $5 \times 10^{-12}$ M and not greater than $7.5 \times 10^{-11}$ M, not greater than $1 \times 10^{-12}$ M and not greater than $1 \times 10^{-10}$ M, or not greater than $1 \times 10^{-12}$ M and not greater than $7.5 \times 10^{-11}$ M, respectively. In this context, although there is no particularly definite lower limit on the dissociation constant with human TfR, it can be, for example, $5 \times 10^{-13}$ M or $1 \times 10^{-13}$ M. Further, Although there is no particularly definite lower limit on the dissociation constant with monkey TfR, it can be, for example, $1 \times 10^{-11}$ M or $1 \times 10^{-12}$ M and the like. The same also applies if the antibody is a single-chain antibody.

Examples of preferable embodiments of the antibody having affinity to hTfR include antibodies in which in the heavy chain variable region,
  (a) CDR1 comprises the amino acid sequence set forth as SEQ ID NO: 62 or SEQ ID NO: 63,
  (b) CDR2 comprises the amino acid sequence set forth as SEQ ID NO: 13 or SEQ ID NO: 14, and
  (c) CDR3 comprises the amino acid sequence set forth as SEQ ID NO: 15 or SEQ ID NO: 16.

Examples of more specific embodiments of the antibody having affinity to hTfR include antibodies in which in the heavy chain variable region,
  (a) CDR1 comprises the amino acid sequence set forth as SEQ ID NO: 62,
  (b) CDR2 comprises the amino acid sequence set forth as SEQ ID NO: 13, and
  (c) CDR3 comprises the amino acid sequence set forth as SEQ ID NO: 15.

In the above mentioned preferable embodiments of the antibody having affinity to hTfR, and more specific embodiments of the antibody having affinity to hTfR, preferred examples of the amino acid sequence of the framework region 3 of the antibody heavy chain include those comprising the amino acid sequence set forth as SEQ ID NO: 64.

Examples of preferable combinations of the light chain and heavy chain of the antibody having affinity to hTfR include those having the amino acid sequences below in the variable regions: a combination of
  a light chain in which
  (a) CDR1 comprises the amino acid sequence set forth as SEQ ID NO: 6 or SEQ ID NO: 7,
  (b) CDR2 comprises the amino acid sequence set forth as SEQ ID NO: 8 or SEQ ID NO: 9, or the amino acid sequence Lys-Val-Ser, and
  (c) CDR3 comprises the amino acid sequence set forth as SEQ ID NO: 10, and
  a heavy chain in which
  (d) CDR1 comprises the amino acid sequence set forth as SEQ ID NO: 62 or SEQ ID NO: 63,
  (e) CDR2 comprises the amino acid sequence set forth as SEQ ID NO: 13 or SEQ ID NO: 14, and
  (f) CDR3 comprises the amino acid sequence set forth as SEQ ID NO: 15 or SEQ ID NO: 16.

Examples of specific embodiments of combinations of the light chain and heavy chain of the antibody having affinity to hTfR include those having the amino acid sequences below in the variable regions: a combination of
a light chain comprising the amino acid sequences set forth as SEQ ID NO: 6 as CDR1, SEQ ID NO: 8 as CDR2, and SEQ ID NO: 10 as CDR3, respectively, and a heavy chain comprising the amino acid sequences set forth as SEQ ID NO: 62 as CDR1, SEQ ID NO: 13 as CDR2, and SEQ ID NO: 15 as CDR3, respectively.

In the above mentioned preferable combinations of the light chain and heavy chain of the antibody having affinity to hTfR, and specific embodiments of combinations of the light chain and heavy chain of the antibody having affinity to hTfR, preferred examples of the amino acid sequence of the framework region 3 of the antibody heavy chain include those having the amino acid sequence set forth as SEQ ID NO: 64.

Examples of preferred embodiments of humanized antibodies having affinity to hTfR include those having the amino acid sequences below:
anti-hTfR antibodies whose light chain variable region comprises the amino acid sequence set forth as SEQ ID NO: 17, SEQ ID NO: 18, SEQ ID NO: 19, SEQ ID NO: 20, SEQ ID NO: 21, or SEQ ID NO: 22, and whose heavy chain variable region comprises the amino acid sequence set forth as SEQ ID NO: 65.

In the amino acid sequences of the light chain variable region set forth as SEQ ID NO: 17, SEQ ID NO: 18, SEQ ID NO: 19, SEQ ID NO: 20, SEQ ID NO: 21, and SEQ ID NO: 22, CDR1 comprises the amino acid sequence set forth as SEQ ID NO: 6 or 7, CDR2 comprises the amino acid sequence set forth as SEQ ID NO: 8 or 9, and CDR3 comprises the amino acid sequence set forth as SEQ ID NO: 10. However, the term CDRs as used above in regard to the amino acid sequences of the light chain variable region set forth as SEQ ID NOs: 17 to 22 is not limited to those specific sequences but may also include a region containing the amino acid sequences of one of the CDRs or include an amino acid sequence comprising not less than 3 consecutive amino acids of one of the above CDRs.

In the amino acid sequence of the heavy chain variable region set forth as SEQ ID NO: 65,
(a) CDR1 comprises the amino acid sequence set forth as SEQ ID NO: 62 or 63,
(b) CDR2 comprises the amino acid sequence set forth as SEQ ID NO: 13 or 14, and
(c) CDR3 comprises the amino acid sequence set forth as SEQ ID NO: 15 or 16, and
the amino acid sequence set forth as SEQ ID NO: 64 is also contained as the framework region 3. However, the term CDRs used above in regard to the amino acid sequences of the heavy chain variable region set forth as SEQ ID NO:65 is not limited to those specific sequences but may also include a region containing the amino acid sequences of one of the CDRs or include an amino acid sequence comprising not less than 3 consecutive amino acids of one of the above CDRs. The same also applies for the framework regions.

Examples of more specific embodiments of the humanized antibody having affinity to hTfR include:
the one that comprises the amino acid sequence set forth as SEQ ID NO: 18 in the light chain variable region and comprises the amino acid sequence set forth as SEQ ID NO: 65 in the heavy chain variable region,
the one that comprises the amino acid sequence set forth as SEQ ID NO: 20 in the light chain variable region and comprises the amino acid sequence set forth as SEQ ID NO: 65 in the heavy chain variable region,
the one that comprises the amino acid sequence set forth as SEQ ID NO: 21 in the light chain variable region and comprises the amino acid sequence set forth as SEQ ID NO: 65 in the heavy chain variable region, and
the one that comprises the amino acid sequence set forth as SEQ ID NO: 22 in the light chain variable region and comprises the amino acid sequence set forth as SEQ ID NO: 65 in the heavy chain variable region.

Examples of more specific embodiments of the humanized antibody having affinity to hTfR include:
the one that comprises the amino acid sequence set forth as SEQ ID NO: 23 in the light chain and the amino acid sequence set forth as SEQ ID NO: 66 in the heavy chain,
the one that comprises the amino acid sequence set forth as SEQ ID NO: 25 in the light chain and the amino acid sequence set forth as SEQ ID NO: 66 in the heavy chain,
the one that comprises the amino acid sequence set forth as SEQ ID NO: 27 in the light chain and the amino acid sequence set forth as SEQ ID NO: 66 in the heavy chain,
the one that comprises the amino acid sequence set forth as SEQ ID NO: 29 in the light chain and the amino acid sequence set forth as SEQ ID NO: 66 in the heavy chain,
the one that comprises the amino acid sequence set forth as SEQ ID NO: 23 in the light chain and the amino acid sequence set forth as SEQ ID NO: 68 in the heavy chain,
the one that comprises the amino acid sequence set forth as SEQ ID NO: 25 in the light chain and the amino acid sequence set forth as SEQ ID NO: 68 in the heavy chain,
the one that comprises the amino acid sequence set forth as SEQ ID NO: 27 in the light chain and the amino acid sequence set forth as SEQ ID NO: 68 in the heavy chain, and
the one that comprises the amino acid sequence set forth as SEQ ID NO: 29 in the light chain and the amino acid sequence set forth as SEQ ID NO: 68 in the heavy chain.
In the above mentioned specific embodiments, the humanized anti-hTfR antibody comprising the amino acid sequence set forth as SEQ ID NO: 66 in the heavy chain is an IgG1-type antibody, and the one comprising the amino acid sequence set forth as SEQ ID NO: 68 is an IgG4-type antibody. Both of them comprise the amino acid sequence set forth as SEQ ID NO: 65 as the variable region.

Examples of more specific embodiments of the humanized antibody which is Fab having affinity to hTfR include:
the one that comprises the amino acid sequence set forth as SEQ ID NO: 23 in the light chain and comprises the amino acid sequence set forth as SEQ ID NO: 61 in the Fab heavy chain,
the one that comprises the amino acid sequence set forth as SEQ ID NO: 25 in the light chain and comprises the amino acid sequence set forth as SEQ ID NO: 61 in the Fab heavy chain,
the one that comprises the amino acid sequence set forth as SEQ ID NO: 27 in the light chain and comprises the amino acid sequence set forth as SEQ ID NO: 61 in the Fab heavy chain, and
the one that comprises the amino acid sequence set forth as SEQ ID NO: 29 in the light chain and comprises the amino acid sequence set forth as SEQ ID NO: 61 in the Fab heavy chain.

In the case where the anti-hTfR antibody is Fab, specific examples of the one in which a different Fc region is added to the Fab heavy chain include:
the one comprises the amino acid sequence set forth as SEQ ID NO: 23 in the light chain and comprises the amino acid sequence set forth as SEQ ID NO: 71 in the Fab heavy chain with the Fc region added thereto, the one comprises the amino acid sequence set forth as SEQ ID NO: 25 in the light chain and comprises the amino acid sequence set forth as SEQ ID NO: 71 in the Fab heavy chain with the Fc region added thereto, the one comprises the amino acid sequence set forth as SEQ ID NO: 27 in the light chain and comprises the amino acid sequence set forth as SEQ ID NO: 71 in the Fab heavy chain with the Fc region added thereto, and the one comprises the amino acid sequence set forth as SEQ ID NO: 29 in the light chain and comprises the amino acid sequence set forth as SEQ ID NO: 71 in the Fab heavy chain with the Fc region added thereto.

When adding the above mentioned different Fc region to the Fab heavy chain, for example, the Fab heavy chain with the Fc region added thereto can be linked, directly or via a linker sequence, to the different protein (A) on the C-terminal side thereof. Besides, the one having the amino acid sequence set forth as SEQ ID NO: 71 is the one in which the human IgG Fc region having the amino acid sequence set forth as SEQ ID NO: 70 is linked, via a linker sequence comprising 25 amino acids that is composed of consecutively linked five copies of the amino acid sequence Gly-Gly-Gly-Gly-Ser (SEQ ID NO: 3), to the N-terminal side of the amino acid sequence of the Fab heavy chain (amino acid sequence: 61) of the humanized anti-hTfR antibody 3N.

Preferred embodiments of the antibody having affinity to hTfR have been exemplified above. The light chain and heavy chain of those anti-hTfR antibodies may be mutated as desired, by substitution, deletion, addition and the like, in their variable-region amino acid sequences in order to adjust the affinity of the anti-hTfR antibody to hTfR to a suitable level.

When replacing on or more amino acids of the light chain variable-region amino acid sequence with other amino acids, the number of amino acids to be replaced is preferably 1-10, more preferably 1-5, still more preferably 1-3, and even more preferably 1-2. When deleting one or more amino acids of the light chain variable-region amino acid sequence, the number of amino acids to be deleted is preferably 1-10, more preferably 1-5, still more preferably 1-3, and even more preferably 1-2. Introduction of a combined mutation of such substitution and deletion of amino acids is also allowed.

When adding one or more amino acids to the light chain variable region, they may be added inside, or on the N-terminal side or the C-terminal side of, the light chain variable-region amino acid sequence, and preferably 1-10, more preferably 1-5, still more preferably 1-3, and even more preferably 1-2, in number. Introduction of a combined mutation of such addition, substitution, and deletion of amino acids is also allowed. Such a mutated light chain variable-region amino acid sequence has a homology preferably not lower than 80%, more preferably not lower than 90%, still more preferably not lower than 95%, to the amino acid sequence of the original light chain variable-region.

In particular, when replacing one or more amino acids of the amino acid sequence of respective CDRs or respective framework regions in the light chain with other amino acids, the number of amino acids to be replaced is preferably 1-5, more preferably 1-3, still more preferably 1-2, and even more preferably 1. When deleting one or more amino acid of the amino acid sequence of the respective CDRs or respective framework regions, the number of amino acids to be deleted is preferably 1-5, more preferably 1-3, still more preferably 1-2, and even more preferably 1. Introduction of a combined mutation of such substitution and deletion of amino acids is also allowed.

When adding one or more amino acids to the amino acid sequence of respective CDRs or respective framework regions in the light chain, they are added inside, or on the N-terminal side or the C-terminal side of, the amino acid sequence, and preferably 1-5, more preferably 1-3, still more preferably 1-2, and even more preferably 1, in number. Introduction of a combined mutation of such addition, substitution, and deletion of amino acids is also allowed. The amino acid sequence of each of such mutated CDRs or framework regions has a homology preferably not lower than 80%, more preferably not lower than 90%, and still more preferably not lower than 95%, to the amino acid sequence of the respective original CDRs.

When replacing one or more amino acids of the amino acid sequence set forth as SEQ ID NO: 65 which is the heavy chain variable region with other amino acids, the number of amino acids to be replaced is preferably 1-10, more preferably 1-5, still more preferably 1-3, and even more preferably 1-2. When deleting one or more amino acids of the heavy chain variable-region amino acid sequence, the number of amino acids to be deleted is preferably 1-10, more preferably 1-5, still more preferably 1-3, and even more preferably 1-2. Introduction of a combined mutation of such substitution and deletion of amino acids is also allowed.

When adding one or more amino acids to the amino acid sequence set forth as SEQ ID NO: 65 which is the heavy chain variable region, they may be added inside, or on the N-terminal side or the C-terminal side of, the heavy chain variable-region amino acid sequence, and preferably 1-10, more preferably 1-5, still more preferably 1-3, and even more preferably 1-2, in number. Introduction of a combined mutation of such addition, substitution, and deletion of amino acids is also allowed. Such a mutated heavy chain variable-region amino acid sequence has a homology preferably not lower than 80%, more preferably not lower than 90%, still more preferably not lower than 95%, to the amino acid sequence of the original heavy chain variable-region.

In particular, when replacing one or more amino acids of the amino acid sequence of respective CDRs or respective framework regions in the amino acid sequence set forth as SEQ ID NO: 65 with other amino acids, the number of amino acids to be replaced is preferably 1-5, more preferably 1-3, still more preferably 1-2, and even more preferably 1. When deleting one or more amino acid of the amino acid sequence of the respective CDRs, the number of amino acids to be deleted is preferably 1-5, more preferably 1-3, still more preferably 1-2, and even more preferably 1. Introduction of a combined mutation of such substitution and deletion of amino acids is also allowed.

When adding one or more amino acids to the amino acid sequence of respective CDRs or respective framework regions in the amino acid sequence set forth as SEQ ID NO: 65, they are added inside, or on the N-terminal side or the C-terminal side of, the amino acid sequence, and preferably 1-5, more preferably 1-3, still more preferably 1-2, and even more preferably 1 in number. Introduction of a combined mutation of such addition, substitution, and deletion of amino acids is also allowed. The amino acid sequence of each of such mutated CDRs has a homology preferably not lower than 80%, more preferably not lower than 90%, and still more preferably not lower than 95%, to the amino acid sequence of the respective original CDRs.

Besides, in the case where the mutation described above such as substitution, deletion, addition is introduced to the amino acid sequence set forth as SEQ ID NO: 65 which is the heavy chain variable region of the anti-hTfR antibody, it is preferable that the amino acid methionine at position 5 from the N-terminal side of the original CDR1 set forth as SEQ ID NO: 62 or 63, and the amino acid leucine at position 17 from the N-terminal side of the framework region 3 set forth as SEQ ID NO: 64 should be conserved at the same position as the original ones. Further, it is preferable that the amino acid sequences of the heavy chain CDR1 and framework region 3 should also be conserved at the same positions as the original ones.

A mutation may be introduced into both the variable regions of the light chain and the heavy chain of the anti-hTfR antibody, by combining the above mutation into the light chain variable region of the anti-hTfR antibody and the above mutation into the heavy chain variable region of the anti-hTfR antibody.

Examples of the above mentioned substitution of one or more amino acids in the amino acid sequence of the variable regions of the heavy chain and the light chain of the anti-hTfR antibody include amino acids classified into the same groups, such as aromatic amino acids (Phe, Trp, Tyr), aliphatic amino acids (Ala, Leu, Ile, Val), polar amino acids (Gln, Asn), basic amino acids (Lys, Arg, His), acidic amino acids (Glu, Asp), amino acids having a hydroxy group (Ser, Thr).

Besides, in the case where introducing a mutation into the anti-hTfR antibody by adding one or more amino acids on its C-terminus or the N-terminus, if the added amino acids are positioned between the anti-hTfR antibody and a different protein (A) when they are fused, the added amino acids constitute part of a linker.

In the above preferred embodiments of the antibody, including humanized antibody, having affinity to hTfR, there is no particular limitation as to the amino acid sequence of the anti-hTfR antibody heavy chain and light chain CDRs, insofar as the antibody has a specific affinity to hTfR and monkey TfR.

However, in the present invention, a human antibody having a relatively high affinity to hTfR and has affinity both to human and monkey TfRs, simultaneously, is one whose dissociation constant with human TfR is preferably not greater than $1 \times 10^{-10}$ M, more preferably not greater than $2.5 \times 10^{-11}$ M, still more preferably not greater than $5 \times 10^{-12}$ M, and even more preferably not greater than $1 \times 10^{-12}$ M, and whose dissociation constant with monkey TfR is preferably not greater than $1 \times 10^{-9}$ M, more preferably not greater than $5 \times 10^{-10}$ M, and still more preferably not greater than $1 \times 10^{-10}$ M, for example, not greater than $7.5 \times 10^{-11}$ M, in particular, as measured by the method described in Example 7.

For example, the dissociation constants with human TfR and monkey TfR are not greater than $1 \times 10^{-10}$ M and not greater than $1 \times 10^{-9}$ M, not greater than $1 \times 10^{-11}$ M and not greater than $5 \times 10^{-10}$ M, not greater than $5 \times 10^{-12}$ M and not greater than $1 \times 10^{-10}$ M, not greater than $5 \times 10^{-12}$ M and not greater than $7.5 \times 10^{-11}$ M, not greater than $1 \times 10^{-12}$ M and not greater than $1 \times 10^{-10}$ M, or not greater than $1 \times 10^{-12}$ M and not greater than $7.5 \times 10^{-11}$ M, respectively. In this context, although there is no particularly definite lower limit on the dissociation constant with human TfR, it can be, for example, $5 \times 10^{-13}$ M or $1 \times 10^{-13}$ M. Further, although there is no particularly definite lower limit on the dissociation constant with monkey TfR, it can be, for example, $5 \times 10^{-11}$ M, $1 \times 10^{-11}$ M, $1 \times 10^{-12}$ M, and so on. The same applies when the antibody is a single-chain antibody.

Specific embodiments of the fusion protein between the humanized antibody, which has affinity to hTfR, and a different protein (A) described above include: those in which the different protein (A) is human acidic α-glucosidase (hGAA), human iduronate 2-sulfatase (hI2S), human α-L-iduronidase (hIDUA), human palmitoyl protein thioesterase 1 (hPPT-1), human acidic sphingomyelinase (hASM), human arylsulfatase A (hARSA), human heparan N-sulfatase (hSGSH), human glucocerebrosidase (hGBA), human tripeptidyl-peptidase 1 (hTPP-1), human α-N-acetylglucosaminidase (hNAGLU), human β-glucuronidase (hGUSB), human acid ceramidase (hAC), human α-L-fucosidase (hFUCA1), or α-mannosidase (hLAMAN).

Specific examples of the fusion protein where the different protein (A) is human acidic α-glucosidase (hGAA) include:

(1) the one that is composed of: the portion consisting of hTfR heavy chain linked, on the C-terminal side or the N-terminal side thereof and via a linker sequence, to hGAA, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of hTfR heavy chain linked, on the C-terminal side or the N-terminal side thereof and via a linker sequence, to hGAA, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of hTfR heavy chain linked, on the C-terminal side or the N-terminal side thereof and via a linker sequence, to hGAA, and the other portion consisting of the hTfR light chain, wherein the amino acid sequence of the heavy chain is set forth as SEQ ID NO: 66 or 68, and the amino acid sequence of the light chain is set forth as SEQ ID NO: 27, (4) the one that is composed of: the portion consisting of hTfR heavy chain linked, on the C-terminal side or the N-terminal side thereof and via a linker sequence, to hGAA, and the other portion consisting of the hTfR light chain, wherein the amino acid sequence of the heavy chain is set forth as SEQ ID NO: 66 or 68, and the amino acid sequence of the light chain is set forth as SEQ ID NO: 29.

Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

Here, the antibody having SEQ ID NO: 66 in the heavy chain is of IgG1 type, and the antibody having SEQ ID NO: 68 is of IgG4 type. Further, hGAA is one having the amino acid sequence set forth as SEQ ID NO: 55 or 56, or a mutant thereof.

More specific examples of the fusion protein where the different protein (A) is human acidic α-glucosidase (hGAA) include:

(1) the one that is composed of: the portion consisting of hTfR heavy chain linked, on the C-terminal side thereof and via the amino acid sequence Gly-Ser, to hGAA, and the other portion consisting of the hTfR light chain, wherein the amino acid sequence of the former is set forth as SEQ ID NO: 57, and the amino acid sequence of the latter is set forth as SEQ ID NO: 23, and (2) the one that is composed of: the portion consisting of hTfR heavy chain linked, on the C-terminal side thereof and via the amino acid sequence Gly-Ser, to hGAA, and the other portion consisting of the hTfR light chain, wherein the amino acid sequence of the former is set forth as SEQ ID NO: 58, and the amino acid sequence of the latter is set forth as SEQ ID NO: 23.

The antibody of (1) is of IgG1 type, and the antibody of (2) is of IgG4 type. Further, hGAA is one having the amino acid sequence set forth as SEQ ID NO: 55.

In (1) above, the amino acid sequence of the hTfR heavy chain, which is included in SEQ ID NO: 57, is the one set forth as SEQ ID NO: 66. Namely, the fusion protein according to (1) above, includes, as a humanized antibody, the amino acid sequence of the light chain set forth as SEQ ID NO: 23 and the amino acid sequence of the heavy chain set forth as SEQ ID NO: 66. In (2) above, the amino acid sequence of the hTfR heavy chain, which is included in SEQ ID NO: 58, is the one set forth as SEQ ID NO: 68. Namely, the fusion protein according to (2) above, includes, as a humanized antibody, the amino acid sequence of the light chain set forth as SEQ ID NO: 23 and the amino acid sequence of the heavy chain set forth as SEQ ID NO: 68.

Specific examples of the fusion protein where the different protein (A) is human acidic α-glucosidase (hGAA) and the humanized antibody is a Fab antibody include:

(1) the one that is composed of: the portion consisting of hTfR Fab heavy chain linked, on the C-terminal side or the N-terminus thereof and via a linker sequence, to hGAA, and the other portion consisting of the hTfR light chain, wherein the amino acid sequence of the Fab heavy chain is set forth as SEQ ID NO: 61, and the amino acid sequence of the light chain is set forth as SEQ ID NO: 23, (2) the one that is composed of: the portion consisting of hTfR Fab heavy chain linked, on the C-terminal side or the N-terminus thereof and via a linker sequence, to hGAA, and the other portion consisting of the hTfR light chain, wherein the amino acid sequence of the Fab heavy chain is set forth as SEQ ID NO: 61, and the amino acid sequence of the light chain is set forth as SEQ ID NO: 25, (3) the one that is composed of: the portion consisting of hTfR Fab heavy chain linked, on the C-terminal side or the N-terminus thereof and via a linker sequence, to hGAA, and the other portion consisting of the hTfR light chain, wherein the amino acid sequence of the Fab heavy chain is set forth as SEQ ID NO: 61, and the amino acid sequence of the light chain is set forth as SEQ ID NO: 27, (4) the one that is composed of: the portion consisting of hTfR Fab heavy chain linked, on the C-terminal side or the N-terminus thereof and via a linker sequence, to hGAA, and the other portion consisting of the hTfR light chain, wherein the amino acid sequence of the Fab heavy chain is set forth as SEQ ID NO: 61, and the amino acid sequence of the light chain is set forth as SEQ ID NO: 29.

Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

A more specific example of the fusion protein where the different protein (A) is human acidic α-glucosidase (hGAA) and the humanized antibody is a Fab antibody includes: the one that is composed of the portion consisting of hTfR Fab heavy chain linked, on the C-terminal side thereof and via a linker sequence, that linker sequence consists of three consectively linked amino acid sequences each set forth as SEQ ID NO: 3, to hGAA, and the other portion consisting of the hTfR light chain, wherein the amino acid sequence of the former is set forth as SEQ ID NO: 89, and the amino acid sequence of the latter is set forth as SEQ ID NO: 23.

The fusion protein where the different protein (A) is human acidic α-glucosidase (hGAA) has affinity both to human and monkey TfRs, simultaneously, and is one whose dissociation constant with monkey TfR is preferably not greater than $1 \times 10^{-10}$ M, more preferably not greater than $5 \times 10^{-11}$ M, whose dissociation constant with human TfR is preferably not greater than $1 \times 10^{-10}$ M, more preferably not greater than $5 \times 10^{-11}$ M, still more preferably not greater than $1 \times 10^{-11}$ M, and even more preferably not greater than $1 \times 10^{-12}$ M, as measured by the method described in Example 7.

For example, the dissociation constants with monkey TfR and human TfR are not greater than $1 \times 10^{-10}$ M and not greater than $1 \times 10^{-10}$ M, not greater than $1 \times 10^{-10}$ M and not greater than $1 \times 10^{-11}$ M, not greater than $1 \times 10^{-10}$ M and not greater than $1 \times 10^{-12}$ M, not greater than $5 \times 10^{-11}$ M and not greater than $1 \times 10^{-11}$ M, not greater than $5 \times 10^{-11}$ M and not greater than $1 \times 10^{-11}$ M, or not greater than $5 \times 10^{-11}$ M and not greater than $1 \times 10^{-12}$ M, respectively. In this context, although there is no particularly definite lower limit on the dissociation constant with monkey TfR, it can be, for example, $1 \times 10^{-11}$ M, $1 \times 10^{-12}$ M, or $1 \times 10^{-13}$ M. Although there is no particularly definite lower limit on the dissociation constant with human TfR, it can be, for example, $1 \times 10^{-12}$ M, $5 \times 10^{-13}$ M, or $1 \times 10^{-13}$ M. The same also applies if the antibody is a single-chain antibody.

Specific examples of the fusion protein where the different protein (A) is human iduronate 2-sulfatase (hI2S) include:

(1) the one that is composed of: the portion consisting of hTfR heavy chain linked, on the C-terminal side or the N-terminal side thereof and via a linker sequence, to hI2S, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of hTfR heavy chain linked, on the C-terminal side or the N-terminal side thereof and via a linker sequence, to hI2S, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of hTfR heavy chain linked, on the C-terminal side or the N-terminal side thereof and via a linker sequence, to hI2S, and the other portion consisting of the hTfR light chain, wherein the amino acid sequence of the heavy chain is set forth as SEQ ID NO: 66 or 68, and the amino acid sequence of the light chain is set forth as SEQ ID NO: 27, (4) the one that is composed of: the portion consisting of hTfR heavy chain linked, on the C-terminal side or the N-terminal side thereof and via a linker sequence, to hI2S, and the other portion consisting of the hTfR light chain, wherein the amino acid sequence of the heavy chain is set forth as SEQ ID NO: 66 or 68, and the amino acid sequence of the light chain is set forth as SEQ ID NO: 29.

Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

Here, the antibody having SEQ ID NO: 66 in the heavy chain is of IgG1 type, and the antibody having SEQ ID NO: 68 is of IgG4 type.

More specific examples of the fusion protein where the different protein (A) is human iduronate 2-sulfatase (hI2S) include:

the one that is composed of: the portion consisting of hTfR heavy chain linked, on the C-terminal side thereof and via the amino acid sequence Gly-Ser, to hI2S, and the other portion consisting of the hTfR light chain, wherein the amino acid sequence of the former is set forth as SEQ ID NO: 53, and the amino acid sequence of the latter is set forth as SEQ ID NO: 23. In this case, the antibody is of IgG1 type. The amino acid sequence of the hTfR heavy chain, which is included in SEQ ID NO: 53, is the one set forth as SEQ ID NO: 66. Namely, this fusion protein includes, as a humanized antibody, the amino acid sequence of the light chain set forth as SEQ ID NO: 23 and the amino acid sequence of the heavy chain set forth as SEQ ID NO: 66. The antibody may be of IgG4 type, and in this case, the amino acid sequence of the heavy chain set forth as SEQ ID NO: 66 may be replaced with the amino acid sequence set forth as SEQ ID NO: 68.

Specific examples of the fusion protein where the different protein (A) is human iduronate 2-sulfatase (hI2S) and the humanized antibody is a Fab antibody include:

(1) the one that is composed of: the portion consisting of hTfR Fab heavy chain linked, on the C-terminal side or the N-terminus thereof and via a linker sequence, to hI2S, and the other portion consisting of the hTfR light chain, wherein the amino acid sequence of the Fab heavy chain is set forth as SEQ ID NO: 61, and the amino acid sequence of the light chain is set forth as SEQ ID NO: 23, (2) the one that is composed of: the portion consisting of hTfR Fab heavy chain linked, on the C-terminal side or the N-terminus thereof and via a linker sequence, to hI2S, and the other portion consisting of the hTfR light chain, wherein the amino acid sequence of the Fab heavy chain is set forth as SEQ ID NO: 61, and the amino acid sequence of the light chain is set forth as SEQ ID NO: 25, (3) the one that is composed of: the portion consisting of hTfR Fab heavy chain linked, on the C-terminal side or the N-terminus thereof and via a linker sequence, to hI2S, and the other portion consisting of the hTfR light chain, wherein the amino acid sequence of the Fab heavy chain is set forth as SEQ ID NO: 61, and the amino acid sequence of the light chain is set forth as SEQ ID NO: 27, (4) the one that is composed of the portion consisting of hTfR Fab heavy chain linked, on the C-terminal side or the N-terminus thereof and via a linker sequence, to hI2S, and the other portion consisting of the hTfR light chain, wherein the amino acid sequence of the Fab heavy chain is set forth as SEQ ID NO: 61, and the amino acid sequence of the light chain is set forth as SEQ ID NO: 29.

Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

Specific examples of the fusion protein where the different protein (A) is hIDUA include:

(1) the one that is composed of: the portion consisting of the hTfR heavy chain linked, on the C-terminal side or the N-terminal side thereof and via a linker sequence, to hIDUA, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hIDUA, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hIDUA, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hIDUA, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hIDUA is one having the amino acid sequence set forth as SEQ ID NO: 75 or 76, or a mutant thereof.

More specific examples of the fusion protein where the different protein (A) is hIDUA include:

(1) the one that is composed of: the portion consisting of the hTfR heavy chain linked, on the C-terminal side thereof and via the amino acid sequence Gly-Ser, to hIDUA, and the other portion consisting of the hTfR light chain, wherein the amino acid sequence of the former is set forth as SEQ ID NO: 90, and the amino acid sequence of the latter is set forth as SEQ ID NO: 23, (2) the one that is composed of: the portion consisting of the hTfR heavy chain linked, on the C-terminal side thereof and via a linker comprising 42 amino acids in total that consists of the amino acid sequence Gly-Ser followed by consecutively linked eight copies of the amino acid sequence set forth as SEQ ID NO: 3, to hIDUA, and the other portion consisting of the hTfR light chain, wherein the amino acid sequence of the former is set forth as SEQ ID NO: 91, and the amino acid sequence of the latter is set forth as SEQ ID NO: 23, (3) the one that is composed of: the portion consisting of the hTfR heavy chain linked, on the C-terminal side thereof and via a linker consisting of consecutively linked 20 copies of the amino acid sequence set forth as SEQ ID NO: 3, to hIDUA, and the other portion consisting of the hTfR light chain, wherein the amino acid sequence of the former is set forth as SEQ ID NO: 92, and the amino acid sequence of the latter is set forth as SEQ ID NO: 23, (4) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hIDUA, and the other portion consisting of the hTfR light chain, wherein the amino acid sequence of the former is set forth as SEQ ID NO: 93, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hIDUA, and the other portion consisting of the hTfR light chain, wherein the amino acid sequence of the former is set forth as SEQ ID NO: 94, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hIDUA, and the other portion consisting of the hTfR light chain, wherein the amino acid sequence of the former is set forth as SEQ ID NO: 95, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hIDUA, and the other portion consisting of the hTfR light chain, wherein the amino acid sequence of the former is set forth as SEQ ID NO: 96, and the amino acid sequence of the latter is set forth as SEQ ID NO: 23, (8) the one that is composed of: the portion consisting of hIDUA linked to the amino acid sequence on the C-terminal side thereof that consists of consecutively linked two copies of the hTfR heavy chain (Fab) having, on the C-terminal side thereof, the linker consisting of consecutively linked six copies of the amino acid sequence set forth as SEQ ID NO: 3, and the other portion consisting of the hTfR light chain, wherein the amino acid sequence of the former is set forth as SEQ ID NO: 97, and the amino acid sequence of the latter is set forth as SEQ ID NO: 23, and (9) the one that is composed of: the portion consisting of hIDUA linked to single-chain humanized anti-hTfR antibody No. 3N(2) set forth as SEQ ID NO: 98, on the C-terminal side thereof and via a linker comprising seven amino acids that consists of the amino acid sequence Gly-Gly following the amino acid sequence set forth as SEQ ID NO: 3, and that is set forth as SEQ ID NO: 99.

The fusion proteins (1) to (3) are those whose antibody is of IgG1 type, and the fusion proteins (4) to (9) are those whose antibody is of Fab type.

Here, the amino acid sequences of the hTfR heavy chains in the above fusion proteins (1) to (3) are set forth as SEQ ID NO: 68. Namely, the above fusion proteins (1) to (3) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (4) to (9) are set forth as SEQ ID NO: 61. Namely, the above fusion proteins (4) to (9) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hPPT-1 include:

(1) the one that is composed of: the portion consisting of the hTfR heavy chain linked, on the C-terminal side or the N-terminal side thereof and via a linker sequence, to hPPT-1, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hPPT-1, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hPPT-1, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hPPT-1, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hPPT-1 is one having the amino acid sequence set forth as SEQ ID NO: 77, or a mutant thereof.

More specific examples of the fusion protein where the different protein (A) is hPPT-1 include:

(1) the one that is composed of: the portion consisting of the hTfR heavy chain linked, on the C-terminal side thereof and via the amino acid sequence Gly-Ser, to hPPT-1, and the other portion consisting of the hTfR light chain, wherein the amino acid sequence of the former is set forth as SEQ ID NO: 100, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hPPT-1, and the other portion consisting of the hTfR light chain, wherein the amino acid sequence of the former is set forth as SEQ ID NO: 101, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hPPT-1, and the other portion consisting of the hTfR light chain, wherein the amino acid sequence of the former is set forth as SEQ ID NO: 102, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hPPT-1, and the other portion consisting of the hTfR light chain, wherein the amino acid sequence of the former is set forth as SEQ ID NO: 103, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hPPT-1, and the other portion consisting of the hTfR light chain, wherein the amino acid sequence of the former is set forth as SEQ ID NO: 104, and the amino acid sequence of the latter is set forth as SEQ ID NO: 23, and (6) the one that is composed of the portion consisting of hPPT-1 linked to the amino acid sequence on the C-terminal side thereof that consists of consecutively linked two copies of the hTfR heavy chain (Fab) having, on the C-terminal side thereof, the linker consisting of consecutively linked six copies of the amino acid sequence set forth as SEQ ID NO: 3, and the other portion consisting of the hTfR light chain, wherein the amino acid sequence of the former is set forth as SEQ ID NO: 105, and the amino acid sequence of the latter is set forth as SEQ ID NO: 23.

The fusion proteins (1) to (4) are those whose antibody is of IgG1 type, and the fusion proteins (5) and (6) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) and (6) are set forth as SEQ ID NO: 61. Namely, the above fusion proteins (5) and (6) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hASM include:

(1) the one that is composed of: the portion consisting of the hTfR heavy chain linked, on the C-terminal side or the N-terminal side thereof and via a linker sequence, to hASM, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hASM, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hASM, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hASM, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hASM is one having the amino acid sequence set forth as SEQ ID NO: 78, or a mutant thereof.

More specific examples of the fusion protein where the different protein (A) is hASM include:

(1) the one that is composed of: the portion consisting of the hTfR heavy chain linked, on the C-terminal side thereof and via the amino acid sequence Gly-Ser, to hASM, and the other portion consisting of the hTfR light chain, wherein the amino acid sequence of the former is set forth as SEQ ID NO: 106, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hASM, and the other portion consisting of the hTfR light chain, wherein the amino acid sequence of the former is set forth as SEQ ID NO: 107, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hASM, and the other portion consisting of the hTfR light chain, wherein the amino acid sequence of the former is set forth as SEQ ID NO: 108, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hASM, and the other portion consisting of the hTfR light chain, wherein the amino acid sequence of the former is set forth as SEQ ID NO: 109, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hASM, and the other portion consisting of the hTfR light chain, wherein the amino acid sequence of the former is set forth as SEQ ID NO: 110, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hASM, and the other portion consisting of the hTfR light chain, wherein the amino acid sequence of the former is set forth as SEQ ID NO: 111, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hASM, and the other portion consisting of the hTfR light chain, wherein the amino acid sequence of the former is set forth as SEQ ID NO: 112, and the amino acid sequence of the latter is set forth as SEQ ID NO: 23, (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hASM, and the other portion consisting of the hTfR light chain, wherein the amino acid sequence of the former is set forth as SEQ ID NO: 113, and the amino acid sequence of the latter is set forth as SEQ ID NO: 23, and (9) the one that is composed of: the portion consisting of hASM linked to the amino acid sequence on the C-terminal side thereof that consists of consecutively linked two copies of the hTfR heavy chain (Fab) having, on the C-terminal side thereof, the linker consisting of consecutively linked six copies of the amino acid sequence set forth as SEQ ID NO: 3, and the other portion consisting of the hTfR light chain, wherein the amino acid sequence of the former is set forth as SEQ ID NO: 114, and the amino acid sequence of the latter is set forth as SEQ ID NO: 23.

The fusion proteins (1) to (4) are those whose antibody is of IgG1 type, and the fusion proteins (5) to (9) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) and (6) are set forth as SEQ ID NO: 61. Namely, the above fusion proteins (5) and (6) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hARSA include:

(1) the one that is composed of: the portion consisting of the hTfR heavy chain linked, on the C-terminal side or the N-terminal side thereof and via a linker sequence, to hARSA, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hARSA, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hARSA, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hARSA, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hARSA is one having the amino acid sequence set forth as SEQ ID NO: 79, or a mutant thereof.

More specific examples of the fusion protein where the different protein (A) is hARSA include:

(1) the one that is composed of: the portion consisting of the hTfR heavy chain linked, on the C-terminal side thereof and via the amino acid sequence Gly-Ser, to hARSA, and the other portion consisting of the hTfR light chain, wherein the amino acid sequence of the former is set forth as SEQ ID NO: 115, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hARSA, and the other portion consisting of the hTfR light chain, wherein the amino acid sequence of the former is set forth as SEQ ID NO: 116, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hARSA, and the other portion consisting of the hTfR light chain, wherein the amino acid sequence of the former is set forth as SEQ ID NO: 117, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hARSA, and the other portion consisting of the hTfR light chain, wherein the amino acid sequence of the former is set forth as SEQ ID NO: 118, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hARSA, and the other portion consisting of the hTfR light chain, wherein the amino acid sequence of the former is set forth as SEQ ID NO: 119, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hARSA, and the other portion consisting of the hTfR light chain, wherein the amino acid sequence of the former is set forth as SEQ ID NO: 120, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hARSA, and the other portion consisting of the hTfR light chain, wherein the amino acid sequence of the former is set forth as SEQ ID NO: 121, and the amino acid sequence of the latter is set forth as SEQ ID NO: 23, (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hARSA, and the other portion consisting of the hTfR light chain, wherein the amino acid sequence of the former is set forth as SEQ ID NO: 122, and the amino acid sequence of the latter is set forth as SEQ ID NO: 23, and (9) the one that is composed of: the portion consisting of hARSA linked to the amino acid sequence on the C-terminal side thereof that consists of consecutively linked two copies of the hTfR heavy chain (Fab) having, on the C-terminal side thereof, the linker consisting of consecutively linked six copies of the amino acid sequence set forth as SEQ ID NO: 3, and the other portion consisting of the hTfR light chain, wherein the amino acid sequence of the former is set forth as SEQ ID NO: 123, and the amino acid sequence of the latter is set forth as SEQ ID NO: 23.

The fusion proteins (1) to (4) are those whose antibody is of IgG1 type, and the fusion proteins (5) to (9) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) to (9) are set forth as SEQ ID NO: 61. Namely, the above fusion proteins (5) to (9) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hSGSH include:

(1) the one that is composed of: the portion consisting of the hTfR heavy chain linked, on the C-terminal side or the N-terminal side thereof and via a linker sequence, to hSGSH, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hSGSH, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hSGSH, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hSGSH, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hSGSH is one having the amino acid sequence set forth as SEQ ID NO: 80, or a mutant thereof.

More specific examples of the fusion protein where the different protein (A) is hSGSH include:

(1) the one that is composed of: the portion consisting of the hTfR heavy chain linked, on the C-terminal side thereof and via the amino acid sequence Gly-Ser, to hSGSH, and the other portion consisting of the hTfR light chain, wherein the amino acid sequence of the former is set forth as SEQ ID NO: 124, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hSGSH, and the other portion consisting of the hTfR light chain, wherein the amino acid sequence of the former is set forth as SEQ ID NO: 125, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hSGSH, and the other portion consisting of the hTfR light chain, wherein the amino acid sequence of the former is set forth as SEQ ID NO: 126, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hSGSH, and the other portion consisting of the hTfR light chain, wherein the amino acid sequence of the former is set forth as SEQ ID NO: 127, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hSGSH, and the other portion consisting of the hTfR light chain, wherein the amino acid sequence of the former is set forth as SEQ ID NO: 128, and the amino acid sequence of the latter is set forth as SEQ ID NO: 23, and (6) the one that is composed of the portion consisting of hSGSH linked to the amino acid sequence on the C-terminal side thereof that consists of consecutively linked two copies of the hTfR heavy chain (Fab) having, on the C-terminal side thereof, the linker consisting of consecutively linked six copies of the amino acid sequence set forth as SEQ ID NO: 3, and the other portion consisting of the hTfR light chain, wherein the amino acid sequence of the former is set forth as SEQ ID NO: 129, and the amino acid sequence of the latter is set forth as SEQ ID NO: 23.

The fusion proteins (1) to (4) are those whose antibody is of IgG1 type, and the fusion proteins (5) and (6) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) and (6) are set forth as SEQ ID NO: 61. Namely, the above fusion proteins (5) and (6) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hGBA include:

(1) the one that is composed of: the portion consisting of the hTfR heavy chain linked, on the C-terminal side or the N-terminal side thereof and via a linker sequence, to hGBA, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hGBA, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hGBA, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hGBA, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hGBA is one having the amino acid sequence set forth as SEQ ID NO: 81, or a mutant thereof.

More specific examples of the fusion protein where the different protein (A) is hGBA include:

(1) the one that is composed of: the portion consisting of the hTfR heavy chain linked, on the C-terminal side thereof and via the amino acid sequence Gly-Ser, to hGBA, and the other portion consisting of the hTfR light chain, wherein the amino acid sequence of the former is set forth as SEQ ID NO: 130, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hGBA, and the other portion consisting of the hTfR light chain, wherein the amino acid sequence of the former is set forth as SEQ ID NO: 131, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hGBA, and the other portion consisting of the hTfR light chain, wherein the amino acid sequence of the former is set forth as SEQ ID NO: 132, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hGBA, and the other portion consisting of the hTfR light chain, wherein the amino acid sequence of the former is set forth as SEQ ID NO: 133, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hGBA, and the other portion consisting of the hTfR light chain, wherein the amino acid sequence of the former is set forth as SEQ ID NO: 134, and the amino acid sequence of the latter is set forth as SEQ ID NO: 23, and (6) the one that is composed of: the portion consisting of hGBA linked to the amino acid sequence on the C-terminal side thereof that consists of consecutively linked two copies of the hTfR heavy chain (Fab) having, on the C-terminal side thereof, the linker consisting of consecutively linked six copies of the amino acid sequence set forth as SEQ ID NO: 3, and the other portion consisting of the hTfR light chain, wherein the amino acid sequence of the former is set forth as SEQ ID NO: 135, and the amino acid sequence of the latter is set forth as SEQ ID NO: 23.

The fusion proteins (1) to (4) are those whose antibody is of IgG1 type, and the fusion proteins (5) and (6) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) and (6) are set forth as SEQ ID NO: 61. Namely, the above fusion proteins (5) and (6) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hTPP-1 include:

(1) the one that is composed of: the portion consisting of the hTfR heavy chain linked, on the C-terminal side or the N-terminal side thereof and via a linker sequence, to hTPP-1, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hTPP-1, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hTPP-1, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hTPP-1, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hTPP-1 is one having the amino acid sequence set forth as SEQ ID NO: 82, or a mutant thereof.

More specific examples of the fusion protein where the different protein (A) is hTPP-1 include:

(1) the one that is composed of: the portion consisting of the hTfR heavy chain linked, on the C-terminal side thereof and via the amino acid sequence Gly-Ser, to hTPP-1, and the other portion consisting of the hTfR light chain, wherein the amino acid sequence of the former is set forth as SEQ ID NO: 136, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hTPP-1, and the other portion consisting of the hTfR light chain, wherein the amino acid sequence of the former is set forth as SEQ ID NO: 137, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hTPP-1, and the other portion consisting of the hTfR light chain, wherein the amino acid sequence of the former is set forth as SEQ ID NO: 138, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hTPP-1, and the other portion consisting of the hTfR light chain, wherein the amino acid sequence of the former is set forth as SEQ ID NO: 139, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hTPP-1, and the other portion consisting of the hTfR light chain, wherein the amino acid sequence of the former is set forth as SEQ ID NO: 140, and the amino acid sequence of the latter is set forth as SEQ ID NO: 23, and (6) the one that is composed of the portion consisting of hTPP-1 linked to the amino acid sequence on the C-terminal side thereof that consists of consecutively linked two copies of the hTfR heavy chain (Fab) having, on the C-terminal side thereof, the linker consisting of consecutively linked six copies of the amino acid sequence set forth as SEQ ID NO: 3, and the other portion consisting of the hTfR light chain, wherein the amino acid sequence of the former is set forth as SEQ ID NO: 141, and the amino acid sequence of the latter is set forth as SEQ ID NO: 23.

The fusion proteins (1) to (4) are those whose antibody is of IgG1 type, and the fusion proteins (5) and (6) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) and (6) are set forth as SEQ ID NO: 61. Namely, the above fusion proteins (5) and (6) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hNAGLU include:

(1) the one that is composed of: the portion consisting of the hTfR heavy chain linked, on the C-terminal side or the N-terminal side thereof and via a linker sequence, to hNAGLU, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hNAGLU, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hNAGLU, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hNAGLU, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hNAGLU is one having the amino acid sequence set forth as SEQ ID NO: 83, or a mutant thereof.

More specific examples of the fusion protein where the different protein (A) is hNAGLU include:

(1) the one that is composed of: the portion consisting of the hTfR heavy chain linked, on the C-terminal side thereof and via the amino acid sequence Gly-Ser, to hNAGLU, and the other portion consisting of the hTfR light chain, wherein the amino acid sequence of the former is set forth as SEQ ID NO: 142, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hNAGLU, and the other portion consisting of the hTfR light chain, wherein the amino acid sequence of the former is set forth as SEQ ID NO: 143, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hNAGLU, and the other portion consisting of the hTfR light chain, wherein the amino acid sequence of the former is set forth as SEQ ID NO: 144, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hNAGLU, and the other portion consisting of the hTfR light chain, wherein the amino acid sequence of the former is set forth as SEQ ID NO: 145, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hNAGLU, and the other portion consisting of the hTfR light chain, wherein the amino acid sequence of the former is set forth as SEQ ID NO: 146, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hNAGLU, and the other portion consisting of the hTfR light chain, wherein the amino acid sequence of the former is set forth as SEQ ID NO: 147, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hNAGLU, and the other portion consisting of the hTfR light chain, wherein the amino acid sequence of the former is set forth as SEQ ID NO: 148, and the amino acid sequence of the latter is set forth as SEQ ID NO: 23, and (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hNAGLU, and the other portion consisting of the hTfR light chain, wherein the amino acid sequence of the former is set forth as SEQ ID NO: 149, and the amino acid sequence of the latter is set forth as SEQ ID NO: 23.

The fusion proteins (1) to (4) are those whose antibody is of IgG1 type, and the fusion proteins (5) to (8) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) to (8) are set forth as SEQ ID NO: 61. Namely, the above fusion proteins (5) to (8) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hGUSB include:

(1) the one that is composed of: the portion consisting of the hTfR heavy chain linked, on the C-terminal side or the N-terminal side thereof and via a linker sequence, to hGUSB, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hGUSB, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hGUSB, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hGUSB, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hGUSB is one having the amino acid sequence set forth as SEQ ID NO: 84, or a mutant thereof.

More specific examples of the fusion protein where the different protein (A) is hGUSB include:

(1) the one that is composed of: the portion consisting of the hTfR heavy chain linked, on the C-terminal side thereof and via the amino acid sequence Gly-Ser, to hGUSB, and the other portion consisting of the hTfR light chain, wherein the amino acid sequence of the former is set forth as SEQ ID NO: 150, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hGUSB, and the other portion consisting of the hTfR light chain, wherein the amino acid sequence of the former is set forth as SEQ ID NO: 151, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hGUSB, and the other portion consisting of the hTfR light chain, wherein the amino acid sequence of the former is set forth as SEQ ID NO: 152, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hGUSB, and the other portion consisting of the hTfR light chain, wherein the amino acid sequence of the former is set forth as SEQ ID NO: 153, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hGUSB, and the other portion consisting of the hTfR light chain, wherein the amino acid sequence of the former is set forth as SEQ ID NO: 154, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hGUSB, and the other portion consisting of the hTfR light chain, wherein the amino acid sequence of the former is set forth as SEQ ID NO: 155, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hGUSB, and the other portion consisting of the hTfR light chain, wherein the amino acid sequence of the former is set forth as SEQ ID NO: 156, and the amino acid sequence of the latter is set forth as SEQ ID NO: 23, and (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hGUSB, and the other portion consisting of the hTfR light chain, wherein the amino acid sequence of the former is set forth as SEQ ID NO: 157, and the amino acid sequence of the latter is set forth as SEQ ID NO: 23.

The fusion proteins (1) to (4) are those whose antibody is of IgG1 type, and the fusion proteins (5) to (8) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) to (8) are set forth as SEQ ID NO: 61. Namely, the above fusion proteins (5) to (8) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hGALC include:

(1) the one that is composed of: the portion consisting of the hTfR heavy chain linked, on the C-terminal side or the N-terminal side thereof and via a linker sequence, to hGALC, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hGALC, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hGALC, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hGALC, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hGALC is one having the amino acid sequence set forth as SEQ ID NO: 85, or a mutant thereof.

More specific examples of the fusion protein where the different protein (A) is hGALC include:

(1) the one that is composed of: the portion consisting of the hTfR heavy chain linked, on the C-terminal side thereof and via the amino acid sequence Gly-Ser, to hGALC, and the other portion consisting of the hTfR light chain, wherein the amino acid sequence of the former is set forth as SEQ ID NO: 158, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hGALC, and the other portion consisting of the hTfR light chain, wherein the amino acid sequence of the former is set forth as SEQ ID NO: 159, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hGALC, and the other portion consisting of the hTfR light chain, wherein the amino acid sequence of the former is set forth as SEQ ID NO: 160, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hGALC, and the other portion consisting of the hTfR light chain, wherein the amino acid sequence of the former is set forth as SEQ ID NO: 161, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hGALC, and the other portion consisting of the hTfR light chain, wherein the amino acid sequence of the former is set forth as SEQ ID NO: 162, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hGALC, and the other portion consisting of the hTfR light chain, wherein the amino acid sequence of the former is set forth as SEQ ID NO: 163, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hGALC, and the other portion consisting of the hTfR light chain, wherein the amino acid sequence of the former is set forth as SEQ ID NO: 164, and the amino acid sequence of the latter is set forth as SEQ ID NO: 23, and (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hGALC, and the other portion consisting of the hTfR light chain, wherein the amino acid sequence of the former is set forth as SEQ ID NO: 165, and the amino acid sequence of the latter is set forth as SEQ ID NO: 23.

The fusion proteins (1) to (4) are those whose antibody is of IgG1 type, and the fusion proteins (5) to (8) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) to (8) are set forth as SEQ ID NO: 61. Namely, the above fusion proteins (5) to (8) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hAC include:

(1) the one that is composed of: the portion consisting of the hTfR heavy chain linked, on the C-terminal side or the N-terminal side thereof and via a linker sequence, to hAC, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hAC, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hAC, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hAC, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hAC is one having the amino acid sequence set forth as SEQ ID NO: 86, or a mutant thereof.

More specific examples of the fusion protein where the different protein (A) is hAC include:

(1) the one that is composed of: the portion consisting of the hTfR heavy chain linked, on the C-terminal side thereof and via the amino acid sequence Gly-Ser, to hAC, and the other portion consisting of the hTfR light chain, wherein the amino acid sequence of the former is set forth as SEQ ID NO: 166, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hAC, and the other portion consisting of the hTfR light chain, wherein the amino acid sequence of the former is set forth as SEQ ID NO: 167, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hAC, and the other portion consisting of the hTfR light chain, wherein the amino acid sequence of the former is set forth as SEQ ID NO: 168, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hAC, and the other portion consisting of the hTfR light chain, wherein the amino acid sequence of the former is set forth as SEQ ID NO: 169, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hAC, and the other portion consisting of the hTfR light chain, wherein the amino acid sequence of the former is set forth as SEQ ID NO: 170, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hAC, and the other portion consisting of the hTfR light chain, wherein the amino acid sequence of the former is set forth as SEQ ID NO: 171, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hAC, and the other portion consisting of the hTfR light chain, wherein the amino acid sequence of the former is set forth as SEQ ID NO: 172, and the amino acid sequence of the latter is set forth as SEQ ID NO: 23, and (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hAC, and the other portion consisting of the hTfR light chain, wherein the amino acid sequence of the former is set forth as SEQ ID NO: 173, and the amino acid sequence of the latter is set forth as SEQ ID NO: 23.

The fusion proteins (1) to (4) are those whose antibody is of IgG1 type, and the fusion proteins (5) to (8) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) to (8) are set forth as SEQ ID NO: 61. Namely, the above fusion proteins (5) to (8) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hFUCA1 include:

(1) the one that is composed of: the portion consisting of the hTfR heavy chain linked, on the C-terminal side or the N-terminal side thereof and via a linker sequence, to hFUCA1, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hFUCA1, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hFUCA1, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hFUCA1, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hFUCA1 is one having the amino acid sequence set forth as SEQ ID NO: 87, or a mutant thereof.

More specific examples of the fusion protein where the different protein (A) is hFUCA1 include:

(1) the one that is composed of: the portion consisting of the hTfR heavy chain linked, on the C-terminal side thereof and via the amino acid sequence Gly-Ser, to hFUCA1, and the other portion consisting of the hTfR light chain, wherein the amino acid sequence of the former is set forth as SEQ ID NO: 174, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hFUCA1, and the other portion consisting of the hTfR light chain, wherein the amino acid sequence of the former is set forth as SEQ ID NO: 175, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hFUCA1, and the other portion consisting of the hTfR light chain, wherein the amino acid sequence of the former is set forth as SEQ ID NO: 176, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hFUCA1, and the other portion consisting of the hTfR light chain, wherein the amino acid sequence of the former is set forth as SEQ ID NO: 177, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hFUCA1, and the other portion consisting of the hTfR light chain, wherein the amino acid sequence of the former is set forth as SEQ ID NO: 178, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hFUCA1, and the other portion consisting of the hTfR light chain, wherein the amino acid sequence of the former is set forth as SEQ ID NO: 179, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hFUCA1, and the other portion consisting of the hTfR light chain, wherein the amino acid sequence of the former is set forth as SEQ ID NO: 180, and the amino acid sequence of the latter is set forth as SEQ ID NO: 23, and (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hFUCA1, and the other portion consisting of the hTfR light chain, wherein the amino acid sequence of the former is set forth as SEQ ID NO: 181, and the amino acid sequence of the latter is set forth as SEQ ID NO: 23.

The fusion proteins (1) to (4) are those whose antibody is of IgG1 type, and the fusion proteins (5) to (8) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) to (8) are set forth as SEQ ID NO: 61. Namely, the above fusion proteins (5) to (8) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is hLAMAN include:

(1) the one that is composed of: the portion consisting of the hTfR heavy chain linked, on the C-terminal side or the N-terminal side thereof and via a linker sequence, to hLAMAN, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of the hTfR heavy chain linked, on the C-terminal side or the N-terminal side thereof and via a linker sequence, to hLAMAN, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of the hTfR heavy chain linked, on the C-terminal side or the N-terminal side thereof and via a linker sequence, to hLAMAN, and the other portion consisting of the hTfR light chain, wherein the amino acid sequence of the heavy chain is set forth as SEQ ID NO: 66 or 68, and the amino acid sequence of the light chain is set forth as SEQ ID NO: 27, and (4) the one that is composed of: the portion consisting of the hTfR heavy chain linked, on the C-terminal side or the N-terminal side thereof and via a linker sequence, to hLAMAN, and the other portion consisting of the hTfR light chain, wherein the amino acid sequence of the heavy chain is set forth as SEQ ID NO: 66 or 68, and the amino acid sequence of the light chain is set forth as SEQ ID NO: 29. Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 or 1 to 20 thereof that are consecutively linked.

Here, the antibody having SEQ ID NO: 66 in the heavy chain is of IgG1 type, and the antibody having SEQ ID NO: 68 is of IgG4 type. Further, the hLAMAN is one having the amino acid sequence set forth as SEQ ID NO: 88, or a mutant thereof.

More specific examples of the fusion protein where the different protein (A) is hLAMAN include:

(1) the one that is composed of: the portion consisting of the hTfR heavy chain linked, on the C-terminal side thereof and via the amino acid sequence Gly-Ser, to hLAMAN, and the other portion consisting of the hTfR light chain, wherein the amino acid sequence of the former is set forth as SEQ ID NO: 182, and the amino acid sequence of the latter is set forth as SEQ ID NO: 23, (2) the one that is composed of: the portion consisting of the hTfR heavy chain linked, on the C-terminal side thereof and via a linker consisting of consecutively linked five copies of the amino acid sequence set forth as SEQ ID NO: 3, to hLAMAN, and the other portion consisting of the hTfR light chain, wherein the amino acid sequence of the former is set forth as SEQ ID NO: 183, and the amino acid sequence of the latter is set forth as SEQ ID NO: 23, (3) the one that is composed of: the portion consisting of the hTfR heavy chain linked, on the C-terminal side thereof and via a linker consisting of consecutively linked ten copies of the amino acid sequence set forth as SEQ ID NO: 3, to hLAMAN, and the other portion consisting of the hTfR light chain, wherein the amino acid sequence of the former is set forth as SEQ ID NO: 184, and the amino acid sequence of the latter is set forth as SEQ ID NO: 23, (4) the one that is composed of: the portion consisting of the hTfR heavy chain linked, on the C-terminal side thereof and via a linker consisting of consecutively linked 20 copies of the amino acid sequence set forth as SEQ ID NO: 3, to hLAMAN, and the other portion consisting of the hTfR light chain, wherein the amino acid sequence of the former is set forth as SEQ ID NO: 185, and the amino acid sequence of the latter is set forth as SEQ ID NO: 23, (5) the one that is composed of: the portion consisting of the hTfR heavy chain (Fab) linked, on the C-terminal side thereof and via a linker consisting of consecutively linked three copies of the amino acid sequence set forth as SEQ ID NO: 3, to hLAMAN, and the other portion consisting of the hTfR light chain, wherein the amino acid sequence of the former is set forth as SEQ ID NO: 186, and the amino acid sequence of the latter is set forth as SEQ ID NO: 23, (6) the one that is composed of: the portion consisting of the hTfR heavy chain (Fab) linked, on the C-terminal side thereof and via a linker consisting of consecutively linked five copies of the amino acid sequence set forth as SEQ ID NO: 3, to hLAMAN, and the other portion consisting of the hTfR light chain, wherein the amino acid sequence of the former is set forth as SEQ ID NO: 187, and the amino acid sequence of the latter is set forth as SEQ ID NO: 23, (7) the one that is composed of: the portion consisting of the hTfR heavy chain (Fab) linked, on the C-terminal side thereof and via a linker consisting of consecutively linked ten copies of the amino acid sequence set forth as SEQ ID NO: 3, to hLAMAN, and the other portion consisting of the hTfR light chain, wherein the amino acid sequence of the former is set forth as SEQ ID NO: 188, and the amino acid sequence of the latter is set forth as SEQ ID NO: 23, and (8) the one that is composed of: the portion consisting of the hTfR heavy chain (Fab) linked, on the C-terminal side thereof and via a linker consisting of consecutively linked 20 copies of the amino acid sequence set forth as SEQ ID NO: 3, to hLAMAN, and the other portion consisting of the hTfR light chain, wherein the amino acid sequence of the former is set forth as SEQ ID NO: 189, and the amino acid sequence of the latter is set forth as SEQ ID NO: 23. The fusion proteins (1) to (4) are those whose antibody is of IgG1 type, and the fusion proteins (5) to (8) are those whose antibody is of Fab type.

Here, the amino acid sequences of the hTfR heavy chains in the above fusion proteins (1) to (4) are set forth as SEQ ID NO: 68. Namely, the above fusion proteins (1) to (4) have a humanized antibody whose light chain includes the amino acid sequence set forth as SEQ ID NO: 23 and whose heavy chain includes the amino acid sequence set forth as SEQ ID NO: 68. Further, the amino acid sequences of the hTfR heavy chains in the above fusion proteins (5) to (8) are set forth as SEQ ID NO: 61. Namely, the above fusion proteins (5) to (8) have a humanized antibody whose light chain includes the amino acid sequence set forth as SEQ ID NO: 23 and whose heavy chain (Fab) includes the amino acid sequence set forth as SEQ ID NO: 61.

Specific examples of the fusion protein where the different protein (A) is a human lysosomal enzyme include:

(1) the one that is composed of: the portion consisting of hTfR heavy chain linked, on the C-terminal side or the N-terminal side thereof and via a linker sequence, to the human lysosomal enzyme, and the other portion consisting of the hTfR light chain, wherein the amino acid sequence of the heavy chain is set forth as SEQ ID NO: 66 or 68, and the amino acid sequence of the light chain is set forth as SEQ ID NO: 23, (2) the one that is composed of: the portion consisting of hTfR heavy chain linked, on the C-terminal side or the N-terminal side thereof and via a linker sequence, to the human lysosomal enzyme, and the other portion consisting of the hTfR light chain, wherein the amino acid sequence of the heavy chain is set forth as SEQ ID NO: 66 or 68, and the amino acid sequence of the light chain is set forth as SEQ ID NO: 25, (3) the one that is composed of: the portion consisting of hTfR heavy chain linked, on the C-terminal side or the N-terminal side thereof and via a linker sequence, to the human lysosomal enzyme, and the other portion consisting of the hTfR light chain, wherein the amino acid sequence of the heavy chain is set forth as SEQ ID NO: 66 or 68, and the amino acid sequence of the light chain is set forth as SEQ ID NO: 27, (4) the one that is composed of: the portion consisting of hTfR heavy chain linked, on the C-terminal side or the N-terminal side thereof and via a linker sequence, to the human lysosomal enzyme, and the other portion consisting of the hTfR light chain, wherein the amino acid sequence of the heavy chain is set forth as SEQ ID NO: 66 or 68, and the amino acid sequence of the light chain is set forth as SEQ ID NO: 29.

Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

Here, the antibody having SEQ ID NO: 66 in the heavy chain is of IgG1 type, and the antibody having SEQ ID NO: 68 is of IgG4 type.

Specific examples of the fusion protein where the different protein (A) is a human lysosomal enzyme and the humanized antibody is a Fab antibody include:

(1) the one that is composed of: the portion consisting of hTfR Fab heavy chain linked, on the C-terminal side or the N-terminus thereof and via a linker sequence, to the human lysosomal enzyme, and the other portion consisting of the hTfR light chain, wherein the amino acid sequence of the Fab heavy chain is set forth as SEQ ID NO: 61, and the amino acid sequence of the light chain is set forth as SEQ ID NO: 23, (2) the one that is composed of: the portion consisting of hTfR Fab heavy chain linked, on the C-terminal side or the N-terminus thereof and via a linker sequence, to the human lysosomal enzyme, and the other portion consisting of the hTfR light chain, wherein the amino acid sequence of the Fab heavy chain is set forth as SEQ ID NO: 61, and the amino acid sequence of the light chain is set forth as SEQ ID NO: 25, (3) the one that is composed of: the portion consisting of hTfR Fab heavy chain linked, on the C-terminal side or the N-terminus thereof and via a linker sequence, to the human lysosomal enzyme, and the other portion consisting of the hTfR light chain, wherein the amino acid sequence of the Fab heavy chain is set forth as SEQ ID NO: 61, and the amino acid sequence of the light chain is set forth as SEQ ID NO: 27, (4) the one that is composed of: the portion consisting of hTfR Fab heavy chain linked, on the C-terminal side or the N-terminus thereof and via a linker sequence, to the human lysosomal enzyme, and the other portion consisting of the hTfR light chain, wherein the amino acid sequence of the Fab heavy chain is set forth as SEQ ID NO: 61, and the amino acid sequence of the light chain is set forth as SEQ ID NO: 29.

Here, it is preferable that the linker sequence is one consisting of a single glycine, a single serine, the amino acid sequence Gly-Ser, the amino acid sequence Gly-Gly-Ser, the amino acid sequence set forth as SEQ ID NO: 3, the amino acid sequence set forth as SEQ ID NO: 4, the amino acid sequence set forth as SEQ ID NO: 5, and the amino acid sequences consisting of 1 to 10 thereof that are consecutively linked.

A human lysosomal enzyme other than above can also be prepared into a fusion protein with the hTfR antibody according to the same embodiments as those described about hGAA and hI2S. Examples of the human lysosomal enzyme include β-galactosidase, GM2 activator protein, β-hexosaminidase A, β-hexosaminidase B, N-acetylglucosamine-1-phosphotransferase, β-mannosidase, galactosylceramidase, saposin C, aspartylglucosaminidase, α-galactosidase A, α-N-acetylglucosaminidase, acetyl CoA:α-glucosaminide N-acetyltransferase, N-acetylglucosamine-6-sulfate sulfatase, amylo-1,6-glucosidase, sialidase, hyaluronidase 1, CLN1, and CLN2, though not limited thereto. Also, when fusing a protein other than the lysosome, the fusion protein may be constructed in the same manner.

The fusion protein where the different protein (A) is a human lysosomal enzyme has an affinity to both human TfR and monkey TfR, and has the following dissociation constant as measured by the method described in Example 7:

dissociation constant with monkey TfR: preferably not greater than $1 \times 10^{-10}$ M, more preferably not greater than $5 \times 10^{-11}$ M; and dissociation constant with human TfR: preferably not greater than $1 \times 10^{-10}$ M, more preferably not greater than $5 \times 10^{-11}$ M, still more preferably not greater than $1 \times 10^{-11}$ M, even more preferably not greater than $1 \times 10^{-12}$ M.

For example, the dissociation constants with monkey TfR and human TfR are not greater than $1 \times 10^{-10}$ M and not greater than $1 \times 10^{-10}$ M, not greater than $1 \times 10^{-10}$ M and not greater than $1 \times 10^{-11}$ M, not greater than $1 \times 10^{-10}$ M and not greater than $1 \times 10^{-12}$ M, not greater than $5 \times 10^{-11}$ M and not greater than $1 \times 10^{-11}$ M, not greater than $5 \times 10^{-11}$ M and not greater than $1 \times 10^{-11}$ M, or not greater than $5 \times 10^{-11}$ M and not greater than $1 \times 10^{-12}$ M, respectively. In this context, although there is no particularly definite lower limit on the dissociation constant with monkey TfR, it can be, for example, $1 \times 10^{-11}$ M, $1 \times 10^{-12}$ M or $1 \times 10^{-13}$ M. Although there is no particularly definite lower limit on the dissociation constant with human TfR, it can be, for example, $1 \times 10^{-12}$ M, $5 \times 10^{-13}$ M or $1 \times 10^{-13}$ M. The same also applies if the antibody is a single-chain antibody.

The anti-hTfR antibody according to the present invention can be used for the production of a pharmaceutical agent for parenteral administration for the treatment of a disease condition of the central nervous system by binding it to the molecule of a physiologically active protein or a pharmacologically active low-molecular-weight compound. And the anti-hTfR antibody conjugated with the molecule of a physiologically active protein or a pharmacologically active low-molecular-weight compound, can be used in the method of treatment of a patient with a disease condition of the central nervous system, in which a therapeutically effective amount of a physiologically active protein or pharmacologically active low-molecular-weight compound is administered to the patient with a disease of the central nervous system parenterally (including intravenous injection such as intravenous infusion). The anti-hTfR antibody conjugated with the molecule of a physiologically active protein or a pharmacologically active low-molecular-weight compound, after parenterally administered, can not only get inside the brain but also reach other organs where hTfR is expressed. Further, the pharmaceutical agent may be used for preventing the onset of a disease.

In particular, as the anti-hTfR antibody of the present invention can, as a conjugate with human acidic α-glucosidase (hGAA), enable hGAA to pass through the blood-brain barrier and function in the brain, the antibody can be used for the production of a pharmaceutical agent for parenteral administration for the treatment of a disease condition of the central nervous system accompanying Pompe's disease. Further, the anti-hTfR antibody conjugated with hGAA can be used in the method of treatment of a patient with a disease condition of the central nervous system disorder accompanying Pompe's disease, in which a therapeutically effective amount of the antibody is administered to the patient with Pompe's disease parenterally (including intravenous injection such as intravenous infusion). The anti-hTfR antibody conjugated with hGAA, after parenterally administered, can not only get inside the brain but also reach other organs where hTfR is expressed. Further, the pharmaceutical agent may be used for preventing the onset of the disease condition.

In particular, as the anti-hTfR antibody of the present invention can, as a conjugate with human iduronate 2-sulfatase (hI2S), enable hI2S to pass through the blood-brain barrier and function in the brain, the antibody can be used for the production of a pharmaceutical agent for parenteral administration for the treatment of a disease condition of the central nervous system accompanying Hunter syndrome. Further, the anti-hTfR antibody conjugated with hI2S can be used in the method of treatment of a patient with a disease condition of the central nervous system disorder accompanying Hunter syndrome, in which a therapeutically effective amount of the antibody is administered to the patient with Hunter syndrome parenterally (including intravenous injection such as intravenous infusion). The anti-hTfR antibody conjugated with hI2S, after parenterally administered, can not only get inside the brain but also reach other organs where hTfR is expressed. Further, the pharmaceutical agent may be used for preventing the onset of the disorders.

In particular, as the anti-hTfR antibody of the present invention can, as a conjugate with human α-L-iduronidase (hIDUA), enable hIDUA to pass through the blood-brain barrier and function in the brain, the antibody can be used for production of a pharmaceutical agent for parenteral administration for the treatment of a disease condition of the central nervous system accompanying the Hurler syndrome. Further, the anti-hTfR antibody conjugated with hIDUA can be used in the method of treatment of a patient with a disease condition of the central nervous system disorder accompanying the Hurler syndrome, in which a therapeutically effective amount of the antibody is administered to the patient with Hurler syndrome parenterally (including intravenous injection such as intravenous infusion). The anti-hTfR antibody conjugated with hIDUA, after parenterally administered, can not only get inside the brain but also reach other organs where hTfR is expressed. The pharmaceutical agent can also be used for prophylaxis of such disease conditions.

Further, in particular, as the anti-hTfR antibody of the present invention can, as a conjugate with a human lysosomal enzyme, enable the human lysosomal enzyme to pass through the blood-brain barrier and function in the brain, the antibody can be used for the production of a pharmaceutical agent for parenteral administration for the treatment of a disease condition of central nervous system caused by deficiency in the human lysosomal enzyme. Further, the anti-hTfR antibody conjugated with the human lysosomal enzyme can be used in the method of treatment of a patient with a disease condition of the central nervous system caused by deficiency in the human lysosomal enzyme, in which a therapeutically effective amount of the antibody is administered to the patient parenterally (including intravenous injection such as intravenous infusion). The anti-hTfR antibody conjugated with the human lysosomal enzyme, after parenterally administered, can not only get inside the brain but also reach other organs where the human lysosomal enzyme is expressed. Further, the pharmaceutical agent may be used for preventing the onset of the disease condition.

The proteins, low-molecular-weight compound and the like that are conjugated with the anti-hTfR antibody of the present invention can be used as pharmaceutical agents which are to exhibit their functions in the central nervous system (CNS) after parenterally administered. Such pharmaceutical agents may be administered to patients generally by intravenous injection such as intravenous injection, subcutaneous injection, intramuscular injection and the like, though there is no particular limitation as to the route of their administration.

The proteins, the low-molecular-weight compounds and the like that are conjugated with the anti-hTfR antibody of the present invention can be provided to medical facilities as pharmaceutical agents in such forms of lyophilized product or aqueous preparation. In the case of an aqueous preparation, it can be provided in the form of preparations in which one of the pharmaceutical agents is dissolved in a solution containing a stabilizer, buffer, and an isotonizer in advance, and sealed in vials or syringes. A type of preparations sealed in a syringe is generally called a prefilled syringe-type preparation. Taking the form of a prefilled syringe-type preparation facilitates patients' self-administration of the pharmaceutical agent.

Where an aqueous preparation is provided, the concentration of the protein, the low-molecular-weight compound or the like conjugated with the anti-hTfR antibody in the aqueous preparation is, e.g., 1-4 mg/mL, though it is to be adjusted as desired in accordance with the dosage. Where there is no particular limitation as to stabilizers to be contained in the aqueous preparation insofar as they are pharmaceutically available, nonionic surfactants may preferably be used. Examples of such nonionic surfactants include polysorbate and poloxamer, either of which may be used alone or in combination. Among polysorbates, polysorbate 20 and polysorbate 80 are preferably used. As poloxamer, poloxamer 188 (polyoxyethylene (160) polyoxypropylene (30) glycol) is particularly preferred. Further, the concentration of nonionic surfactant contained in the aqueous preparation is preferably 0.01-1 mg/mL, more preferably, 0.01-0.5 mg/mL, and still more preferably 0.1-0.5 mg/mL. As stabilizers, amino acids such as histidine, arginine, methionine, and glycine may also be used. Where employed as a stabilizer, the concentration of an amino acid in the aqueous preparation is preferably 0.1-40 mg/mL, more preferably 0.2-5 mg/mL, and still more preferably 0.5-4 mg/mL. While there is no particular limitation as to a buffer to be contained in the aqueous preparation insofar as it is pharmaceutically available, phosphate buffer is preferred, and more preferred is sodium phosphate buffer. Where used as a buffer, the concentration of sodium phosphate is preferably 0.01-0.04 M. The pH of the aqueous preparation adjusted with a buffer is preferably 5.5-7.2. While there is no particular limitation as to an isotonizer to be contained in the aqueous preparation insofar as it is pharmaceutically available, sodium chloride or mannitol may be preferably used alone or in combination as an isotonizer.

EXAMPLES

Though the present invention is described in further detail below with reference to examples, it is not intended that the present invention be limited to those examples. Examples 1 to 15 are about Reference Example (antibody No. 3).

Example 1

Construction of hTfR Expression Vector

Employing human spleen Quick Clone cDNA (Clontech Inc.) as a template and using primer hTfR5' (SEQ ID NO:41) and primer hTfR3' (SEQ ID NO:42), PCR was performed to amplify the gene fragment encoding human transferrin receptor (hTfR). The amplified fragment encoding hTfR was digested with MluI and NotI, and then inserted between MluI and NotI sites of vector pCI-neo (Promega Inc.). The vector thus prepared was designated pCI-neo(hTfR). This vector then was digested with MluI and NotI to cut out the gene fragment encoding hTfR, and this fragment was inserted between MluI and NotI sites of pE-mIRES-GS-puro, an expression vector disclosed in an international publication WO 2012/063799 to construct an hTfR expression vector, pE-mIRES-GS-puro(hTfR).

Example 2

Preparation of Recombinant hTfR

Into CHO-K1 cells was introduced pE-mIRES-GS-puro (hTfR) by electroporation, and the cells then were subjected to selection culture in a CD OptiCHO™ medium (Invitrogen Inc.) containing methionine sulfoximine (MSX) and puromycin to prepare recombinant hTfR expressing cells. The recombinant hTfR expressing cells were cultured, and recombinant hTfR was prepared.

Example 3

Immunization of Mouse with Recombinant hTfR

Mice were immunized with recombinant hTfR prepared in Example 2 as antigen. Immunization was carried out by intravenously or intraperitoneally injecting the mice with the antigen.

Example 4

Preparation of Hybridoma Cells

About one week after the last injection, the spleens of the mice were excised and homogenized to isolate spleen cells. The spleen cells thus obtained were fused with cells of mouse myeloma cell line (P3.X63.Ag8.653) by the polyethylene glycol method. After cell fusion, the cells were suspended in a RPMI 1640 medium containing (1×) HAT supplement (Life Technologies Inc.) and 10% Ultra low IgG fetal bovine serum (Life Technologies Inc.), and the cell suspension was dispensed to 20 of 96-well plates, 200 μL/well. After the cells were cultured for 10 days in a carbon dioxide gas incubator (37° C., 5% $CO_2$), each well was examined under a microscope, and the wells that contain a single colony were selected.

When the cells in each well reached near confluence, the culture supernatant was collected as a culture supernatant of hybridoma, and subjected to the following screening process.

Example 5

Screening of High Affinity Antibody Producing Cell Line

The recombinant hTfR solution (Sino Biologics Inc.) was diluted with 50 mM sodium phosphate buffer (pH 9.5-9.6) to 5 μg/mL to prepare a solid phase solution. After 50 μL of the solid phase solution was added to each well of a Nunc MaxiSorp™ flat-bottom 96-well plate (substrate: polystyrene, mfd. by Nunc Inc.), the plate was left to stand for one hour at room temperature to let the recombinant hTfR adhere to the plate and become immobilized. The solid phase solution was discarded, each well was washed three times with 250 μL of washing solution (PBS containing PBS-T: 0.05% Tween20), 200 μL of a blocking solution (PBS containing 1% BSA) then was added to each well, and the plate was left to stand for one hour at room temperature.

The blocking solution was discarded, and each well was washed three times with 250 μL of PBS-T. To each well was added 50 μL of the hybridoma culture supernatant, and the plate was left to stand for one hour at room temperature to let the mouse anti-hTfR antibody contained in the culture supernatant bind to the recombinant hTfR. At the same time, to some wells was added 50 μL of culture supernatant of a hybridoma that did not produce mouse anti-hTfR antibody, as a control. In addition, 50 μL of the medium for hybridoma culture was added to the wells, as mock wells, beside those wells to which the culture supernatant was added. Measurement was conducted in an n=2 fashion. Then, the solution was discarded, and each well was washed three times with 250 μL of PBS-T.

To each of the above wells was added 100 μL of HRP-labelled goat anti-mouse immunoglobulin antibody solution (Promega Inc.), and the plate was left to stand for 30 minutes at room temperature. The solution then was discarded, and each well was washed three times with 250 μL of PBS-T. To each well as added 50 μL of a chromogenic substrate solution, TMB Stabilized Substrate for Horseradish Peroxidase (Promega Inc.), and the wells were left to stand for 10 to 20 minutes at room temperature. Then, following addition of 100 μL of a stop solution (2N sulfuric acid), the absorbance of each well was measured on a plate reader at 450 nm. Of the two wells for each of the culture supernatant and control, the mean values were taken, respectively, and from each of the mean values, the respective mean value for the two mock wells placed corresponding to each of the culture supernatant and the control, was subtracted, giving the measurement.

Fourteen types of hybridoma cells corresponding to culture supernatants added to the wells which exhibited the higher measurements were selected as the cell lines (high affinity antibody producing cell line) that produce antibodies exhibiting high affinities to hTfR (high affinity anti-hTfR antibody). These fourteen types of cell lines were designated as Clone 1 line to Clone 14 line. Clone 3 line was selected from these cell lines and used in the experiments below. Further, the anti-hTfR antibody produced by Clone 3 line was designated as anti-hTfR antibody No. 3.

Example 6

Analysis of the Variable-Region Amino Acid Sequence of the High Affinity Anti-hTfR Antibodies From the Clone 3 line selected in Example 5, cDNA was prepared, using which as a template the genes encoding the light chain and the heavy chain of the antibody was amplified. By translating the nucleotide sequence of the amplified genes, the respective amino acid sequences of the light chain and heavy chain variable regions were determined for the anti-hTfR antibody No. 3 produced by the cell line.

The anti-hTfR antibody No.3 was found to include the amino acid sequence set forth as SEQ ID NO:48 as the light chain variable region, and the amino acid sequence set forth as SEQ ID NO:49 as the heavy chain variable region. The light chain variable region was found to include the amino acid sequence set forth as SEQ ID NO:6 or 7 as CDR1; SEQ ID NO:8 or 9 as CDR2, and SEQ ID NO:10 as CDR3; and the heavy chain variable region to include the amino acid sequence set forth as SEQ ID NO:11 or 12 as CDR1, SEQ ID NO:13 or 14 as CDR2, and SEQ ID NO:15 or 16 as CDR3. However, it was also considered that CDRs are not limited to those which consist of these amino acid sequences, but they can also either be regions of amino acid sequences that include any of the above sequences, or amino acid sequences consisting of not less than three consecutive amino acids containing part of the above sequences.

Table 1 shows collectively the SEQ ID NOs of the respective amino acid sequences contained in CDR1 to CDR3 of the light chain variable region and CDR1 to CDR3 of the heavy chain variable region of anti-hTfR antibody No. 3. However, Table 1 shows those amino acid sequence only as examples and does not limit the amino acid sequence of each CDR to those in Table 1, but it was considered that CDRs are not limited to those which consist of these amino acid sequences, but they can also either be regions of amino acid sequences that include any of the above sequences, or amino acid sequences consisting of not less than three consecutive amino acids containing part of the above sequences.

TABLE 1

Sequence numbers of respective amino acid sequences contained in CDR1 to CDR3 of the light chain and the heavy chain variable regions of anti-hTfR antibodies Nos. 3

| Antibody | light chain variable region | | | heavy chain variable region | | |
| --- | --- | --- | --- | --- | --- | --- |
| No. | CDR1 | CDR2 | CDR3 | CDR1 | CDR2 | CDR3 |
| 3 | 6, 7 | 8, 9 | 10 | 11, 12 | 13, 14 | 15, 16 |

Example 7

Measurement of the Affinity of Anti-hTfR Antibody to Human and Monkey TfRs

The affinity of the anti-hTfR antibody to human and monkey TfRs were measured on Octet RED96 (ForteBio Inc., a division of Pall Corporation), a system for analysis of interactions between biomolecules utilizing bio-layer interferometry (BLI). The basic principles of bio-layer interferometry are briefly explained below. When a layer of a biomolecule immobilized on the surface of a sensor tip is irradiated with light of a certain wavelength, the light is reflected from two of the surfaces, the one of the biomolecule and the other of inner, reference layer, producing interfering light waves. A molecule in the sample being measured binds to the biomolecule on the surface of the sensor tip and thus increases the thickness of the layers on the sensor tip, which results in a shift between the interfering waves. By measuring the variations of this shift between the interfering waves, determination of the number of the molecules bound to the layer of the biomolecules immobilized to the sensor tip surface and kinetic analysis of it can be performed in real time. The measurement was performed according generally to the operating manual attached to Octet RED96. As a human TfR, a recombinant human TfR (r human TfR: Sino Biological Inc.) was used, which had the amino acid sequence of the hTfR extracellular region, i.e., the cysteine residue at position 89 from the N-terminal side to the phenylalanine at the C-terminus, of the amino acid sequence set forth as SEQ ID NO:1, with a histidine tag attached to the N-terminus. As a monkey TfR, a recombinant monkey TfR (r monkey TfR: Sino Biological Inc.) was used, which had the amino acid sequence of the crab-eating monkey TfR extracellular region, i.e., the cysteine residue at position 89 from the N-terminal side to the phenylalanine at the C-terminus, of the amino acid sequence set forth as SEQ ID NO:2, with a histidine tag attached to the N-terminus.

Clone 3 line selected in Example 5 was diluted with a RPMI 1640 medium containing (1×) HAT Supplement (Life Technologies Inc.) and 10% Ultra low IgG fetal bovine serum (Life Technologies Inc.) so as to adjust the cell density to approximately $2 \times 10^5$ cells/mL. To a 1-L conical flask were added 200 mL of each cell suspension, and the culture was performed for 6 to 7 days in a wet environment at 37° C., 5% $CO_2$ and 95% air, with stirring at a rate of about 70 rpm. The culture medium was centrifuged, and then filtered through a 0.22 μm filter (Millipore Inc.) to collect a culture supernatant. The culture supernatant thus collected was loaded onto a Protein G column (column volume: 1 mL, GE Healthcare Inc.) that had been equilibrated in advance with three column volumes of 20 mM Tris buffer (pH 8.0) containing 150 mM NaCl. After the column was washed with 5 column volumes of the same buffer, adsorbed antibody was eluted with 4 column volumes of 50 mM glycine buffer (pH 2.8) containing 150 mM NaCl, and eluted fractions were collected. The fractions eluted were adjusted to pH 7.0 by addition of 1 M Tris buffer (pH 8.0). These were used as purified products of anti-hTfR antibody No. 3 in the experiments described below.

The purified product of anti-hTfR antibody No. 3 was subjected to 2-fold dilution steps with HBS-P+ (10 mM HEPES containing 150 mM NaCl, 50 μM EDTA and 0.05% Surfactant P20) to prepare antibody solutions of 7 different concentrations, 0.78125 to 50 nM (0.117 to 7.5 μg/mL). The antibody solution was used as the sample solution. The r human and r monkey TfRs were respectively diluted with HBS-P+ to prepare 25 μg/mL solutions, which were used as r human TfR-ECD (Histag) solution and r monkey TfR-ECD (Histag) solution, respectively.

Each of the sample solutions prepared above by 2-fold dilution steps was added, 200 μL/well, to a 96-well plate, black (Greiner Bio-One Inc.). Each of the r human TfR-ECD (Histag) solution and the r monkey TfR-ECD (Histag) solutions prepared above was added, 200 μL/well, to predetermined wells. To respective wells for baseline, dissociation and washing were added HBS-P+, 200 μL/well. To wells for regeneration were added 10 mM Glycine-HCl (pH 1.7), 200 μL/well. To wells for activation was added 0.5 mM $NiCl_2$ solution, 200 μL/well. The plate and biosensor (Biosensor/Ni-NTA: ForteBio Inc., a division of Pall Corporation) were set in the prescribed positions of Octet RED96.

Octet RED96 was run under the conditions shown in Table 2 below to collect data, on which then, using the analyzing software attached to Octet RED96, and fitting the binding reaction curve to 1:1 binding model or 2:1 binding model, the association rate constant (kon) and dissociation rate constant (koff) of anti-hTfR antibody to r human TfR and r monkey TfR were measured and the dissociation constant ($K_D$) was calculated. The measurement was performed at 25 to 30° C.

TABLE 2

Operating conditions of Octet RED96

| Step | | Contact time (sec) | Rate (rpm) | Threshold |
|---|---|---|---|---|
| 1 | Baseline 1 | 60 | 1000 | — |
| 2 | Load | 600 | 1000 | 1.5-2.0 |
| 3 | Baseline 2 | 60 | 1000 | — |
| 4 | Association | 180 | 1000 | — |
| 5 | Dissociation | 540 | 1000 | — |
| 6 | Regeneration | 5 | 1000 | — |
| 7 | Washing | 5 | 1000 | — |
| | Steps 6-7 repeated 6 to 7 times | | | |
| 8 | Activation | 60 | 1000 | — |
| | Steps 1-8 repeated until all the samples measured | | | |

Table 3 shows the results of measurement of association rate constant (kon), dissociation rate constant (koff) of anti-hTfR antibody No. 3, and dissociation constant ($k_D$) to human TfR and monkey TfR.

TABLE 3

Affinity of anti-hTfR antibody No. 3 for human TfR and monkey TfR

| | kon ($M^{-1}s^{-1}$) | koff ($s^{-1}$) | $K_D$ (M) |
|---|---|---|---|
| Human TfR | $6.53 \times 10^5$ | $<1.0 \times 10^{-7}$ | $<1.0 \times 10^{-12}$ |
| Monkey TfR | $3.89 \times 10^5$ | $<1.0 \times 10^{-7}$ | $<1.0 \times 10^{-12}$ |

As a result of the affinity measurement of the anti-hTfR antibody to human TfR, the dissociation constant of anti-hTfR antibody No. 3 with human TfR was not more than $1 \times 10^{-12}$ M, and the dissociation constant with monkey TfR was not more than $1 \times 10^{-12}$ M. The result shows that anti-hTfR antibody No. 3 is an antibody having a high affinity not only to human TfR but also to monkey TfR.

Example 7-2

Evaluation of Transfer of the Anti-hTfR Antibodies into the Brain Using Mice

Then, for anti-hTfR antibody No. 3, evaluation was performed about the transfer into the brain through the BBB, by using hTfR knock-in mice (hTfR-KI mice) in which the gene encoding the extracellular region of mouse transferrin receptor has been replaced with a gene encoding the extracellular region of human transferrin receptor. The hTfR-KI mice were produced by the method described below as a whole. Besides, the purified products prepared in Example 7 were used as anti-hTfR antibody No. 3.

A DNA fragment having a nucleotide sequence set forth as SEQ ID NO:45 was chemically synthesized, in which a neomycin resistance gene flanked by loxP sequences was placed on the 3'-side of a cDNA encoding a chimeric hTfR whose intracellular region consisted of the amino acid sequence of mouse TfR and the extracellular region consisted of the amino acid sequence of human hTfR sequence. This DNA fragment was inserted by a conventional method into a targeting vector having as the 5'-arm sequence a nucleotide sequence set forth as SEQ ID NO:46 and as the 3'-arm sequence a nucleotide sequence set forth as SEQ ID NO:47, and the construct was introduced into mouse ES cells by electroporation. The mouse ES cells to which the gene had been introduced were subjected to selection culture in a medium in the presence of neomycin to select those mouse ES cells in which the targeting vector had been incorporated into the chromosome through homologous recombination. The recombinant mouse ES cells thus obtained were injected into 8-cell stage embryos (host embryos) of ICR mice, and the embryos thus prepared were implanted into pseudo pregnant mice (recipient mice) which had been obtained through mating with mice having undergone vasoligation. The offspring (chimeric mice) obtained were examined by their hair color, and those mice which had the higher proportion of white hairs in their total body hairs were selected, i.e., those mice in which the ES cells had contributed at the higher rates in the development of the individual organisms. Each of these chimeric mice was mated with ICR mice to generate F1 mice. F1 mice with white hair were selected, the DNAs extracted from their tail tissue were analyzed, and those mice whose mouse transferrin receptor gene on their chromosomes had been replaced with chimeric hTfR, were regarded as hTfR-KI mice.

The purified product of anti-hTfR antibody No. 3 were fluorescent labeled with fluorescein isothiocyanate (FITC) using Fluorescein Labeling Kit-NH$_2$ (Dojindo Laboratories) according to the attached manual. PBS solution containing the FITC fluorescent labeled antibody was prepared. The PBS antibody solution was intravenously injected to an hTfR-KI mouse (male, 10 to 12-week old), at the anti-hTfR antibody dosage of 3 mg/kg. As a control, a PBS solution containing mouse IgG1 (Sigma Inc.), fluorescent labeled with FITC in the same manner as above, was intravenously injected to an hTfR-KI mouse (male, 10 to 12-week old), at the dose of 3 mg/kg. About eight hours after the intravenous injection, the whole body was irrigated with physiological saline, and the brain (part including the cerebrum and the cerebellum) obtained. The brain thus excised was weighed (wet weight), and then the brain tissues were homogenized with T-PER (Thermo Fisher Scientific Inc.) containing Protease Inhibitor Cocktail (Sigma Inc.). The homogenate was centrifuged, the supernatant was collected, and the amount of the FITC fluorescent labeled antibody contained in the supernatant was measured in the following manner. First, 10 μL of anti-FITC Antibody (Bethyl Inc.) was added to each well of a High Bind Plate (Meso Scale Diagnostics Inc.) and left to stand for one hour so as to immobilize it to the plate. Then, the plate was blocked by addition of 150 μL of SuperBlock Blocking buffer in PBS (Thermo Fisher Scientific Inc.) to each well and shaking of the plate for one hour. Then, 25 μL of the supernatant of a brain tissue homogenate was added to each well, and the plate was shaken for one hour. Then, 25 μL of SULFO-TAG Anti-Mouse Antibody (Goat)(Meso Scale Diagnostics Inc.) were added to each well, and shaking was continued for one hour. Then, to each well was added 150 μL of Read buffer T (Meso Scale Diagnostics Inc.), and the amount of luminescence from each well was read on a Sector™ Imager 6000 reader. The amount of the anti-hTfR antibody contained per one gram brain (wet weight) (the concentration of the anti-hTfR antibody in the brain tissues) was calculated, by producing a standard curve based on measurements of standard samples containing known concentrations of FITC fluorescent labeled anti-hTfR antibody, and then interpolating the measurement of each of the samples with reference to the standard. The results are shown in Table 4.

The concentration of anti-hTfR antibody No. 3 in brain tissues was about 27.8 times as high as that of the control. The result indicates that anti-hTfR antibody No. 3 transfers into the brain, actively passing through the BBB.

TABLE 4

Concentration of anti-hTfR antibodies in in brain tissues

| Antibody No. | Brain tissues (μg/g wet weight) | Relative value to the control |
|---|---|---|
| Control | 0.003 | 1 |
| 3 | 0.0833 | 27.8 |

Example 8

Pharmacokinetic Analysis of Anti-hTfR Antibodies in Monkey

Anti-hTfR antibody No. 3 was intravenously administered once to a male crab-eating monkey at a dosage of 5.0 mg/kg, and 8 hours after the administration, whole body irrigation was carried out with physiological saline. As a negative control, a monkey which had not received anti-hTfR antibody was subjected to whole body irrigation in the same manner. After the irrigation, brain tissues including the medulla oblongata were excised. Using the brain tissues, the concentration of the anti-hTfR antibody was measured, and immunohistochemical staining was performed. Anti-hTfR antibody No. 3 employed were purification products of those described in Example 7.

Measurement of the concentration of anti-hTfR antibodies in brain tissues were carried out largely following the procedure described below. Collected brain tissues were divided into the cerebrum, the cerebellum, the hippocampus, and the medulla oblongata, and they were respectively homogenized with RIPA Buffer (Wako Pure Chemical Industries Inc.) containing Protease Inhibitor Cocktail (Sigma-Aldrich Inc.), and centrifuged to collect the supernatant. Affinipure Goat Anti mouse IgG Fcγ pAb (Jackson ImmunoResearch Inc.) was added, 10 μL each, to the wells of a High Bind Plate (Meso Scale Diagnostics Inc.), and the plate was left to stand for one hour to immobilize the antibody. Then, the plate was blocked by addition of 150 μL of SuperBlock Blocking buffer in PBS (Thermo Fisher Scientific Inc.) to each well and shaken for one hour. Then, 25 μL of the supernatant of a brain tissue homogenate was added to each well, and the plate was shaken for one hour. Then, 25 μL of Affinipure Goat Anti mouse IgG Fab-Biotin (Jackson ImmunoResearch Inc.) was added to each well, and shaking was continued for one hour. Then, 25 μL or SULFO-Tag-Streptavidin (Meso Scale Diagnostics Inc.) was added to each well, and shaking was continued for 30 minutes. To each well was added 150 μL of Read buffer T (Meso Scale Diagnostics Inc.), and the amount of luminescence from each well was read on a Sector™ Imager 6000 reader (Meso Scale Diagnostics). The amount of the anti-hTfR antibody contained per one gram of brain (wet weight) (the concentration of the anti-hTfR antibody in brain tissues) was calculated, by producing a standard curve based on measurements of standard samples containing known concentrations of the anti-hTfR antibody, and then interpolating the measurement of each of the samples with reference to the standard.

The result of the measurement of the concentration of the anti-hTfR antibodies in brain tissues is shown in Table 5. Anti-hTfR antibody No. 3 was observed to accumulate in all of the cerebrum, the cerebellum, the hippocampus and the medulla oblongata. These results demonstrate that anti-hTfR antibody No. 3 had a property to pass through the blood brain barrier and accumulate in the brain tissues, and show that by binding these antibodies to a pharmaceutical agent which needs to be brought into function in the brain tissues, it is possible to let those pharmaceutical agents efficiently accumulate in the brain tissues.

TABLE 5

| Antibody No. | Concentration of anti-hTfR antibodies in brain tissues (μg/g wet weight) | | | |
|---|---|---|---|---|
| | Cerebrum | Cerebellum | Hippo-campus | Cervical cord |
| 3 | 0.72 | 0.6 | 0.33 | 0.31 |

Immunohistochemical staining of the anti-hTfR antibodies in these brain tissues was carried out following the procedures described below as a whole. The collected tissues were rapidly frozen to −80° C. in a Tissue-Tek Cryo 3DM (Sakura Finetek Inc.) to prepare frozen blocks of tissues. The frozen blocks were sliced into 4-μm sections, and which were applied to MAS coated glass slides (Matsunami Glass Inc.). The tissue sections were reacted with 4% paraformaldehyde (Wako Pure Chemical Industries Inc.) for 5 minutes at 4° C. and affixed to glass slides. Then, the tissue sections were reacted with methanol solution containing 0.3% hydrogen peroxide (Wako Pure Chemical Industries Inc.) for 30 min to inactivate intrinsic peroxidases. Then, the glass slides were blocked by reacting SuperBlock blocking buffer in PBS for 30 min at room temperature. Then, the tissue sections were reacted with Mouse IgG-heavy and light chain Antibody (Bethyl Laboratories Inc.) for one hour at room temperature. The tissue sections were allowed to develop a color with DAB substrate (3,3′-diaminobenzidine, Vector Laboratories Inc.), counterstained with Mayer's hematoxylin solution (Merck Inc.), dehydrated, cleared, embedded, and observed under a microscope.

FIG. 1 shows the result of the immunohistochemical staining of the anti-hTfR antibodies in the cerebral cortex. In the cerebral cortex of monkeys administered anti-hTfR antibody No. 3, specific staining of blood vessels were observed (FIG. 1b). Further, the brain parenchyma region, outside the blood vessels, was also observed specifically stained extensively. In contrast, no staining was observed in the cerebral cortex of the control monkey administered with no anti-hTfR antibody, indicating that there was almost no background staining (FIG. 1a).

Figure 2:
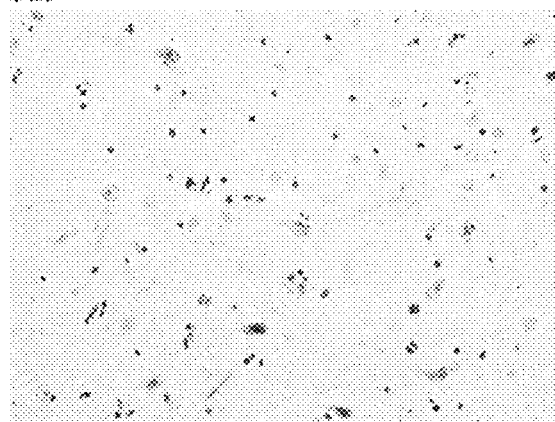
FIG. 2 A figure showing the result of the immunohistochemical staining of the anti-hTfR antibody in the hippocampus of a crab-eating monkey after a single intravenous administration of the anti-hTfR antibody. (a) anti-hTfR antibody not administered, (b) anti-hTfR antibody No.3 administered. The bar at the bottom right in each photograph is a 50-μm gauge.
Figure 2:
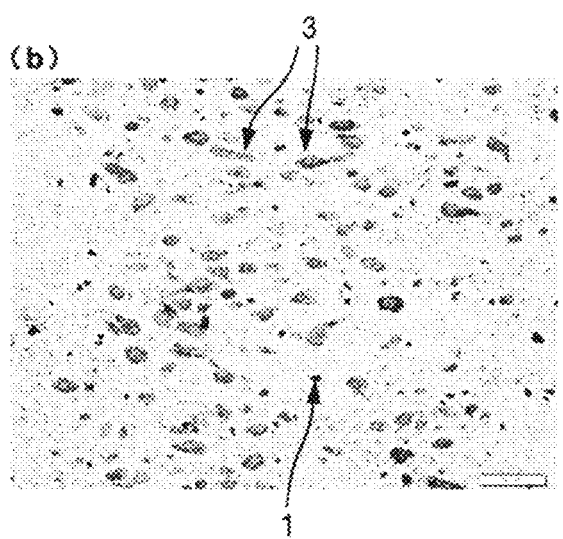

FIG. 2 shows the result of immunohistochemical staining of anti-hTfR antibodies in the hippocampus. In the cerebral cortex of monkeys administered anti-hTfR antibody No. 3, specific staining of blood vessels was observed (FIG. 2b). Further, specific staining of nerve-like cells was also observed, and specific and extensive staining of the brain parenchyma region, outside the blood vessels, was also observed. On the other hand, no staining was observed in the hippocampus of the control administered with no anti-hTfR antibody, indicating that there was almost no background staining (FIG. 2a).

Figure 3:
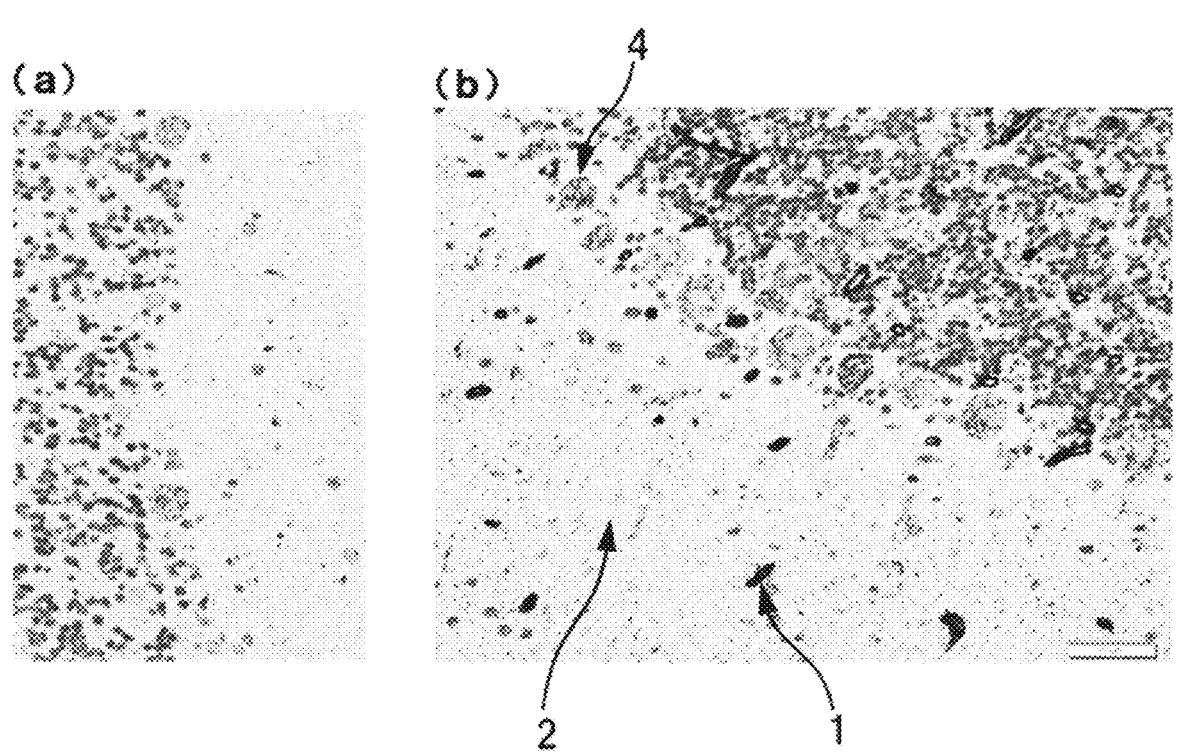
FIG. 3 Substitute photographs for drawings showing the result of the immunohistochemical staining of the anti-hTfR antibody in the cerebellum of a crab-eating monkey after a single intravenous administration of the anti-hTfR antibody. (a) anti-hTfR antibody not administered, (b) anti-hTfR antibody No.3 administered. The bar at the bottom right in each photograph is a 50-μm gauge.

FIG. 3 shows the result of immunohistochemical staining of the anti-hTfR antibodies in the cerebellum. In the cerebral cortex of monkeys administered anti-hTfR antibody No. 3, specific staining of blood vessels were observed (FIG. 3b). Further, specific staining of Purkinje cells was also observed. In contrast, no staining was observed in the cerebellum of the control with no anti-hTfR antibody administered, indicating that there was almost no background staining (FIG. 3a).

From the above results of immunohistochemical staining in the cerebrum, the hippocampus, and the cerebellum, it was found that anti-hTfR antibody No. 3 can bind to hTfR occurring on the endothelium of blood vessels of the brain, and after binding to hTfR, they pass through the blood-brain barrier and transfer into the brain parenchyma, and further, from the brain parenchyma to nerve-like cells in the hippocampus, and are taken up by Purkinje cells in the cerebellum.

Example 9

Preparation of Humanized Anti-hTfR Antibodies

Humanization was tried of the amino acid sequence included in the light chain and the heavy chain variable regions of anti-hTfR antibody No. 3. Thus, a humanized light chain variable region having one of the amino acid sequences set forth as SEQ ID NO:17 to SEQ ID NO:22, and a humanized heavy chain variable region having one of the amino acid sequences set forth as SEQ ID NO:31 to SEQ ID NO:36 were obtained.

Example 10

Construction of Genes Encoding Humanized Anti-hTfR Antibodies

For anti-hTfR antibody No. 3 above, DNA fragments were artificially synthesized which contained a gene encoding the full length of the light chain, and of the heavy chain, having humanized anti-hTfR antibody light chain and heavy chain variable regions, respectively. In doing this, a MluI sequences and a sequence encoding a leader peptide was added, in this order from the 5′ end, on the 5′ side of the gene encoding the full length of the light chain, and on the 3′ side was added a NotI sequence. And, a MluI sequences and a sequence encoding a leader peptide was added, in this order from the 5′ end, on the 5′ side of the gene encoding the full length of the heavy chain, and on the 3′ side was added a NotI sequence. The leader peptide introduced above is to function as secretion signal when the light chain and heavy chain of the humanized antibody is expressed in mammalian cells as host cells so that the light chain and the heavy chain are secreted out of the cells.

For the light chain of anti-hTfR antibody No.3, a DNA fragment (SEQ ID NO:24) was synthesized, which included a gene encoding the full length of the light chain (the light chain of humanized anti-hTfR antibody No.3) consisting of the amino acid sequence set forth as SEQ ID NO:23, which had in the variable region the amino acid sequence set forth as SEQ ID NO:18.

As to the light chain of anti-hTfR antibody No.3, also synthesized were, a DNA fragment (SEQ ID NO:26) encoding the full length amino acid sequence of the light chain (the light chain of humanized anti-hTfR antibody No.3-2) consisting of the amino acid sequence set forth as SEQ ID NO:25, which had in the variable region the amino acid sequence set forth as SEQ ID NO:20;

a DNA fragment (SEQ ID NO:28) encoding the full length amino acid sequence of the light chain (the light chain of humanized anti-hTfR antibody No.3-3) consisting of the amino acid sequence set forth as SEQ ID NO:27, which had in the variable region the amino acid sequence set forth as SEQ ID NO:21;

a DNA fragment (SEQ ID NO:30) encoding the full length amino acid sequence of the light chain (the light chain of humanized anti-hTfR antibody No.3-4) consisting of the amino acid sequence set forth as SEQ ID NO:29, which had in the variable region the amino acid sequence set forth as SEQ ID NO:22.

For the heavy chain of anti-hTfR antibody No. 3, a DNA fragment (SEQ ID NO: 38) was synthesized, which encoded the full length of the heavy chain (the heavy chain of humanized anti-hTfR antibody No. 3) consisting of the amino acid sequence set forth as SEQ ID NO: 37, which had in the variable region the amino acid sequence set forth as SEQ ID NO: 32. The heavy chain of the humanized anti-hTfR antibody encoded by the DNA fragment set forth as SEQ ID NO: 38 is IgG1.

Further, for the heavy chain of anti-hTfR antibody No.3, also synthesized was a DNA fragment (SEQ ID NO:40) encoding the full length amino acid sequence of the heavy chain (the heavy chain IgG4 of humanized anti-hTfR antibody No.3) consisting of the amino acid sequence set forth as SEQ NO:39, which had in the variable region the amino acid sequence set forth as SEQ ID NO:32;

The heavy chain of the humanized anti-hTfR antibody encoded by the DNA fragment set forth as SEQ ID NO:40 is IgG4.

Example 11

Construction of Humanized Anti-hTfR Antibody Expression Vector

Vector pEF/myc/nuc (Invitrogen Inc.) was digested with KpnI and NcoI to cut out a region including EF-1α promoter and its first intron, and this was blunt-ended with T4 DNA polymerase. A region including the CMV enhancer/promoter and intron was removed from pCI-neo (Invitrogen Inc.) by digesting it with BglII and EcoRI, and the remaining fragment thus left was blunt-ended with T4 DNA polymerase. To this was inserted the above-mentioned region including EF-1α promoter and its first intron to construct pE-neo vector. This vector, pE-neo, was digested with SfiI and BstXI to remove a region of approximately 1 kb including a neomycin resistance gene. PCR was performed employing pcDNA3.1/Hygro(+)(Invitrogen) as a template and using primer Hyg-Sfi5' (SEQ ID NO:43) and primer Hyg-BstX3' (SEQ ID NO:44) to amplify hygromycin gene. The hygromycin gene thus amplified was digested with SfiI and BstXI and inserted into the above pE-neo vector from which neomycin resistance gene had been removed to construct a vector pE-hygr.

Vectors pE-hygr and pE-neo were both digested with MluI and NotI. The DNA fragment (SEQ ID NO:24) encoding the light chain of humanized anti-hTfR antibody No. 3 and the DNA fragment (SEQ ID NO:38) encoding the heavy chain of the antibody, both synthesized in Example 10, were digested with MluI and NotI, and the fragments thus obtained were inserted into vector pE-hygr and vector pE-neo, respectively, between their MluI and NotI sites. The vectors thus obtained were used as an expression vector for the light chain of humanized anti-hTfR antibody No. 3, pE-hygr(LC3), and as an expression vector for the heavy chain of the antibody, pE-neo(HC3), in the experiments described below.

Further, as to the light chain of anti-hTfR antibody No.3, the following fragments synthesized in Example 10, namely:

the DNA fragment (SEQ ID NO:26) encoding the light chain of humanized anti-hTfR antibody No.3-2, the DNA fragment (SEQ ID NO:28) encoding the light chain of humanized anti-hTfR antibody No.3-3, and the DNA fragment (SEQ ID NO:30) encoding the light chain of humanized anti-hTfR antibody No.3-4, were digested with MluI and NotI, and inserted into the vector pE-hygr between the MluI and NotI sites thereof to construct pE-hygr(LC3-2), an expression vector for the light chain of humanized anti-hTfR antibody No.3-2, pE-hygr(LC3-3), an expression vector for the light chain of humanized anti-hTfR antibody No.3-3, and pE-hygr(LC3-4), an expression vector for the light chain of humanized anti-hTfR antibody No.3-4, respectively.

Further, in the same manner as above, as to the heavy chain of anti-hTfR antibody No. 3, the DNA fragment (SEQ ID NO:40) encoding the heavy chain IgG4 of humanized anti-hTfR antibody No.3 synthesized in Example 10 was digested with MluI and NotI, and inserted into the vector pE-neo between the MluI and NotI sites thereof to construct pE-neo(HC3-IgG4), an expression vector for the heavy chain IgG4 of humanized anti-hTfR antibody No. 3.

Example 12

Construction of Cells for Expression of Humanized Anti-hTfR Antibody

CHO cells (CHO-K1: purchased from American Type Culture Collection) were transformed with pE-hygr(LC3), the vector for light chain expression, and pE-neo(HC3), the vector for heavy chain expression, both constructed in Example 11, as follows, using GenePulser (Bio-Rad Inc.). Transformation of the cells was performed in the following manner as a whole. CHO-K1 cells, $5 \times 10^5$, were seeded in a 3.5-cm culture dish containing CD OptiCHO™ medium (Life Technologies Inc.) and cultured overnight at 37° C., 5% $CO_2$. The medium was replaced with Opti-MEM™ I medium (Life Technologies Inc.), and the cells were suspended at the density of $5 \times 10^6$ cells/mL. One hundred μL of the cell suspension were taken, to which was added 5 μL each of a pE-hygr(LC3) solution and a pE-neo(HC3) plasmid DNA solution both having been diluted with Opti-MEM™ I medium to 100 μg/mL. These plasmids were introduced into the cells by electroporation using GenePulser (Bio-Rad Inc.). The cells then were cultured overnight under the condition of 37° C., 5% $CO_2$, and subjected to selection culture in D OptiCHO™ medium supplemented with 0.5 mg/mL of hygromycin and 0.8 mg/mL of G418.

Then, the cells selected above through the selection culture were seeded on 96-well plates so that not more than one cell was seeded per well by limiting dilution. The cells then were cultured for about 10 days so that monoclonal colonies were formed. Respective culture supernatants of the wells in which monoclonal colony was formed were collected, the amount of the humanized antibody contained in culture supernatants was determined by ELISA, and humanized antibody high-expressing cell lines were selected.

The ELISA above was conducted as follows in general. To each well of 96-well microtiter plates (Nunc Inc.) were added 100 µL of a goat anti-human IgG polyclonal antibody solution diluted with 0.05 M sodium bicarbonate buffer (pH 9.6) to 4 µg/mL, and the plate was left to stand for at least one hour at room temperature so as to allow the antibody to be adsorbed by the plates. Then, after the well were washed three times with PBS-T, 200 µL of Starting Block (PBS) Blocking Buffer (Thermo Fisher Scientific Inc.) was added to each well, and the plates were left to stand for 30 minutes at room temperature. After each well was washed with PBS-T three times, the culture supernatant or the human IgG standard product which had been diluted with a PBS supplemented with 0.5% BSA and 0.05% Tween20 (PBS-BT) to appropriate concentrations, was added to each well, in the amount of 100 µL, and the plates were left to stand for at least one hour at room temperature. After the plates were washed three times with PBS-T, 100 µL of HRP-labeled anti-human IgG polyclonal antibody solution which had been diluted with PBS-BT, was added to each well, and the plates were left to stand for at least one hour at room temperature. After the wells were washed three times with PBS-T, 0.4 mg/mL o-phenylenediamine in citrate-phosphate buffer (pH 5.0) was added to each well, in the amount of 100 µL, and the wells were left to stand for 8 to 20 minutes at room temperature. Then, 1 mol/L sulfuric acid was added to each well, in the amount of 100 µL to terminate the reaction, and the absorbance for each well was measured at 490 nm using a 96-well plate reader. The cells corresponding to the wells which exhibited the higher measurements were regarded as a high-expressing cell line for humanized anti-hTfR antibody No. 1. This was designated antibody No.3 expressing cell line.

Further, in the same manner, CHO cells were transformed with the light chain expression vector pE-hygr(LC3-2) and the heavy chain expression vector pE-neo(HC3), both constructed in Example 11, and a high-expressing cell line for humanized anti-hTfR antibody No.3-2 was obtained. This was designated antibody No.3-2 expressing cell line.

Further, in the same manner, CHO cells were transformed with the light chain expression vector pE-hygr(LC3-3) and the heavy chain expression vector pE-neo(HC3), both constructed in Example 11, and a high-expressing cell line for humanized anti-hTfR antibody No.3-3 was obtained. This was designated antibody No.3-3 expressing cell line.

Further, in the same manner, CHO cells were transformed with the light chain expression vector pE-hygr(LC3-4) and the heavy chain expression vector pE-neo(HC3) both constructed in Example 11, and a high-expressing cell line for humanized anti-hTfR antibody No.3-4 was obtained. This was designated antibody No.3-4 expressing cell line.

Further, in the same manner, CHO cells were transformed with the light chain expression vector pE-hygr(LC3) and the heavy chain expression vector pE-neo(HC3-IgG4) both constructed in Example 11, and a high-expressing cell line for humanized anti-hTfR antibody No.3(IgG4) was obtained. This was designated antibody No.3(IgG4) expressing cell line.

Further, in the same manner, CHO cells were transformed with the light chain expression vector pE-hygr(LC3-2) and the heavy chain expression vector pE-neo(HC3-IgG4) both constructed in Example 11, and a high-expressing cell line for humanized anti-hTfR antibody No.3-2 (IgG4) was obtained. This was designated antibody No.3-2 (IgG4) expressing cell line.

Example 13

Purification of Humanized Anti-hTfR Antibodies

Antibody No.3 expressing cell line, antibody No.3-2 expressing cell line, antibody No.3-3 expressing cell line and antibody No.3-4 expressing cell line obtained in Example 12 were respectively diluted with CD OptiCHO™ medium to the density of approximately $2 \times 10^5$ cells/mL. The cell suspensions, 200 mL, was added to a 1 L-conical flask, and cultured for 6 to 7 days in a wet environment at 37° C., 5% $CO_2$, 95% air, with stirring at a rate of about 70 rpm. Each culture supernatant was collected by centrifugation, and filtered through a 0.22 µm filter (Millipore Inc.) to prepare the culture supernatant. To each culture supernatant thus obtained was added five volumes of 20 mM Tris buffer (pH 8.0) containing 150 mM NaCl, and loaded onto a Protein A column (column volume: 1 mL, Bio-Rad Inc.) which had been equilibrated in advance with three column volumes of 20 mM Tris buffer (pH 8.0) containing 150 mM NaCl. Then, the column was washed with five column volumes of the same buffer, and the adsorbed humanized antibody was eluted with four column volumes of 50 mM glycine buffer (pH 2.8) containing 150 mM NaCl, and the eluted fraction was collected. The eluted fractions was added and neutralized with 1 M Tris buffer (pH 8.0) and used as the purified antibody preparation.

In the above, the antibody purified from the culture supernatant of antibody No.3 expressing cell line was designated humanized anti-hTfR antibody No.3. The antibody purified from the culture supernatant of antibody No.3-2 expressing cell line was designated humanized anti-hTfR antibody No.3-2. The antibody purified from the culture supernatant of antibody No.3-3 expressing cell line was designated humanized anti-hTfR antibody No.3-3. The antibody purified from the culture supernatant of antibody No.3-4 expressing cell line was designated humanized anti-hTfR antibody No.3-4.

Further, antibody No.3(IgG4) expressing cell line and antibody No.3-2 (IgG4) expressing cell line obtained in Example 12 also were cultured in the same manner as above, and from their culture supernatants were obtained purified humanized anti-hTfR antibody No.3(IgG4) and humanized anti-hTfR antibody No.3-2 (IgG4), respectively. These two antibodies were employed in the pharmacokinetic analysis using monkeys described in Example 15.

Example 14

Measurement of Affinity of Humanized Anti-hTfR Antibodies to Human TfR and Monkey TfR The affinity of the humanized anti-hTfR antibodies obtained in Example 13 to human and monkey TfRs was measured by the method described in Example 7. Table 6 shows the result of the measurement of the association rate constant (kon), dissociation rate constant (koff), and dissociation constant ($k_D$) of humanized anti-hTfR antibodies Nos. 3 to 3-4 (corresponding to Nos. 3 to 3-4, respectively, in the table) to human TfR.

TABLE 6

Affinity of humanized anti-hTfR antibodies to human TfR

| Antibody No. | kon ($M^{-1}s^{-1}$) | koff ($s^{-1}$) | $K_D$ (M) |
|---|---|---|---|
| 3   | $1.19 \times 10^6$ | $<1.0 \times 10^{-7}$ | $<1.0 \times 10^{-12}$ |
| 3-2 | $6.06 \times 10^5$ | $1.45 \times 10^{-5}$ | $2.39 \times 10^{-11}$ |
| 3-3 | $6.00 \times 10^5$ | $1.25 \times 10^{-5}$ | $2.09 \times 10^{-11}$ |
| 3-4 | $1.01 \times 10^6$ | $<1.0 \times 10^{-7}$ | $<1.0 \times 10^{-12}$ |

Table 7 shows the result of the measurement of the association rate constant (kon), dissociation rate constant (koff), and dissociation constant ($k_D$) of humanized anti-hTfR antibodies Nos. 3 to 3-4 (corresponding to Nos. 3 to 3-4, respectively, in the table) to monkey TfR.

TABLE 7

Affinity of humanized anti-hTfR antibodies to monkey TfR

| Antibody No. | kon ($M^{-1}s^{-1}$) | koff ($s^{-1}$) | $K_D$ (M) |
|---|---|---|---|
| 3   | $6.03 \times 10^5$ | $6.76 \times 10^{-4}$ | $1.12 \times 10^{-9}$ |
| 3-2 | $4.95 \times 10^5$ | $8.76 \times 10^{-4}$ | $1.77 \times 10^{-9}$ |
| 3-3 | $4.88 \times 10^5$ | $9.32 \times 10^{-4}$ | $1.91 \times 10^{-9}$ |
| 3-4 | $5.19 \times 10^5$ | $1.35 \times 10^{-4}$ | $2.60 \times 10^{-10}$ |

The result of the measurement of the affinity of humanized anti-hTfR antibody Nos. 3 to 3-4 to human TfR showed that the dissociation constant between humanized anti-hTfR antibodies Nos. 3 and 3-4 and human TfR was less than $1 \times 10^{-12}$ M (Table 6). And the dissociation constant between humanized anti-hTfR antibodies Nos. 3-2 and 3-3 and human TfR was $2.39 \times 10^{-11}$ M and $2.09 \times 10^{-11}$ M, respectively. At the same time, the dissociation constant between the pre-humanized anti-hTfR antibodies (antibody No. 3) corresponding to those antibodies and human TfR was: $1 \times 10^{-12}$ M (Table 3). These results demonstrate that the high affinity of those pre-humanized anti-hTfR antibodies to human TfR was maintained after humanization of the antibodies.

Then, looking to the result of measurement of the affinity of humanized anti-hTfR antibodies to monkey TfR, regarding to humanized anti-hTfR antibodies Nos. 3 to 3-4, while the dissociation constant of anti-hTfR antibody No.3, the pre-humanized antibody corresponding to them, to monkey TfR was less than $1 \times 10^{-12}$ M, their dissociation constant after humanization was $2.60 \times 10^{-10}$ M to $1.91 \times 10^{-9}$ M, showing a lowering of the affinity to monkey TfR. As to the humanized anti-hTfR antibody No.3, although a lowering of affinity to monkey TfR was observed, the result indicates that the pre-humanized high affinity of anti-hTfR antibody to monkey TfR was not lost after its humanization but was maintained as a whole.

Example 15

Pharmacokinetic Analysis of Humanized Anti-hTfR Antibody in Monkey

Using monkeys, pharmacokinetic analysis was performed with four antibodies: humanized anti-hTfR antibody No.3, humanized anti-hTfR antibody No.3-2, humanized anti-hTfR antibody No.3 (IgG4), and humanized anti-hTfR antibody No.3-2 (IgG4). Besides, the heavy chain of humanized anti-hTfR antibody No.3 was IgG1, while in humanized anti-hTfR antibody No.3 (IgG4), the heavy chain of humanized anti-hTfR antibody No.3 had been converted into IgG4, with its variable region kept intact. Further, the heavy chain of humanized anti-hfR antibody No.3-2 was IgG1, while in humanized anti-hTfR antibody No.3-2 (IgG4), the heavy chain of humanized anti-hTfR antibody No.3-2 had been converted into IgG4 with its variable region kept intact. These four antibodies were respectively intravenously administered once to male crab-eating monkeys, at a dosage of 5.0 mg/kg, and their peripheral blood was sampled before the administration, 2 minutes, 30 minutes, 2 hours, 4 hours and 8 hours after the administration, and then they were subjected to whole body irrigation. As a negative control, trastuzumab (Herceptin™, Chugai Pharmaceutical Co., Ltd.), a humanized antibody to HER2 protein, was intravenously administered once to a single monkey in the same manner, and its peripheral blood was sampled before the administration, 2 minutes, 30 minutes, 2 hours, 4 hours and 8 hours after the administration, and then it was subjected to the whole body irrigation. After the irrigation, the brain and spine tissues including the medulla oblongata and other tissues (liver, heart, spleen and bone marrow) were excised. Using these brain and spinal tissues and other tissues, the concentration of the humanized anti-hTfR antibodies was measured and immunohistochemical staining was carried out.

Measurement of the concentration of humanized anti-hTfR antibodies in tissues and peripheral blood was carried out largely following the procedure described below. Besides, as to the brain, the obtained tissues were separated into the cerebral cortex, the cerebellum, the hippocampus and the medulla oblongata, and then the concentration of the humanized anti-hTfR antibodies were measured. The respective tissues thus obtained were homogenized with RIPA Buffer (Wako Pure Chemical Industries Inc.) containing Protease Inhibitor Cocktail (Sigma-Aldrich Inc.), centrifuged, and the supernatant collected. From the above peripheral blood, serum was separated. Anti-Human Kappa Light Chain Goat IgG Biotin (Immuno-Biological Laboratories Co, Ltd.), Sulfo-tag anti-human IgG (H+L) antibody (Bethyl Inc.) and the brain tissue homogenate were added to a streptavidin plate (Meso Scale Diagnostics Inc.) blocked with SuperBlock blocking buffer in PBS (Thermo Fisher Scientific Inc.), and the plate was shaken for one hour for immobilization. To each well was added 150 µL of Read buffer T (Meso Scale Diagnostics Inc.), and the amount of luminescence from each well was measured on a Sector™ Imager 6000 reader. The amount of the antibody contained in each tissue and the peripheral blood was calculated by producing a standard curve based on measurements of standard samples containing known concentrations of the anti-hTfR antibody, and then interpolating the measurement of each of the samples with reference to the standard. Measurement of concentration was repeated three times for each sample.

The result of measurement of the concentration of humanized anti-hTfR antibodies in the brain and spinal tissues is shown in Table 9.

TABLE 8

Concentration of humanized anti-hTfR antibodies in brain tissues (μg/g wet weight)

| Antibody No. | Cerebral cortex | Cerebellum | Hippo-campus | Medulla oblongata | Spinal cord |
|---|---|---|---|---|---|
| 3 | 0.67 ± 0.12 | 0.61 ± 0.02 | 0.49 ± 0.02 | 0.59 ± 0.10 | 0.46 ± 0.17 |
| 3-2 | 1.05 ± 0.07 | 0.72 ± 0.04 | 0.72 ± 0.07 | 0.69 ± 0.03 | 0.46 ± 0.02 |
| 3(IgG4) | 0.65 ± 0.05 | 0.59 ± 0.03 | 0.56 ± 0.02 | 0.59 ± 0.02 | 0.46 ± 0.07 |
| 3-2(IgG4) | 0.76 ± 0.02 | 0.57 ± 0.07 | 0.62 ± 0.05 | 0.73 ± 0.16 | 0.48 ± 0.03 |
| Negative control | 0.0082 ± 0.0032 | 0.0090 ± 0.0067 | 0.0053 ± 0.0009 | 0.011 ± 0.003 | 0.15 ± 0.04 |

All the antibodies, i.e., humanized anti-hTfR antibody No.3, humanized anti-hTfR antibody No.3-2, humanized anti-hTfR antibody No.3 (IgG4) and humanized anti-hTfR antibody No.3-2 (IgG4), were observed to accumulate in the cerebral cortex, cerebellum, hippocampus, medulla oblongata and spinal cord (Table 8). The respective amount accumulated was as follow:

with humanized anti-hTfR antibody No.3, approximately 82 times in the cerebral cortex, approximately 68 times in the cerebellum, approximately 92 times in the hippocampus, approximately 54 times in the medulla oblongata, and approximately 3.1 times in the spinal cord, in comparison with the negative control, trastuzumab (Herceptin™), with humanized anti-hTfR antibody No.3-2, approximately 128 times in the cerebral cortex, approximately 80 times in the cerebellum, approximately 136 times in the hippocampus, approximately 63 times in the medulla oblongata, approximately 3.1 times in the spinal cord, in comparison with the negative control, trastuzumab, with humanized anti-hTfR antibody No.3 (IgG4), approximately 79 times in the cerebral cortex, approximately 66 times in the cerebellum, approximately 106 times in the hippocampus, approximately 54 times in the medulla oblongata, approximately 3.1 times in the spinal cord, in comparison with the negative control, trastuzumab, and with humanized anti-hTfR antibody No.3-2 (IgG4), approximately 93 times in the cerebral cortex, approximately 63 times in the cerebellum, approximately 117 times in the hippocampus, approximately 66 times in the medulla oblongata, approximately 3.2 times in the spinal cord, in comparison with the negative control, trastuzumab (Table 9).

These results indicate that these four humanized anti-hTfR antibodies have a property that allows them to pass through the blood-brain barrier and accumulate in the brain tissues, and that it is now possible to let pharmaceutical agents which need to be brought into function in the brain tissues efficiently accumulate there, by binding such pharmaceutical agents to one of these antibodies.

TABLE 9

Amount of humanized anti-hTfR antibodies accumulated in brain tissues (factors in comparison with negative control)

| Antibody No. | Cerebral cortex | Cerebellum | Hippo-campus | Medulla oblongata | Spinal cord |
|---|---|---|---|---|---|
| 3 | 82 | 68 | 92 | 54 | 3.1 |
| 3-2 | 128 | 80 | 136 | 63 | 3.1 |
| 3(IgG4) | 79 | 66 | 106 | 54 | 3.1 |
| 3-2(IgG4) | 93 | 63 | 117 | 66 | 3.2 |
| Negative control | 1 | 1 | 1 | 1 | 1 |

Figure 4:
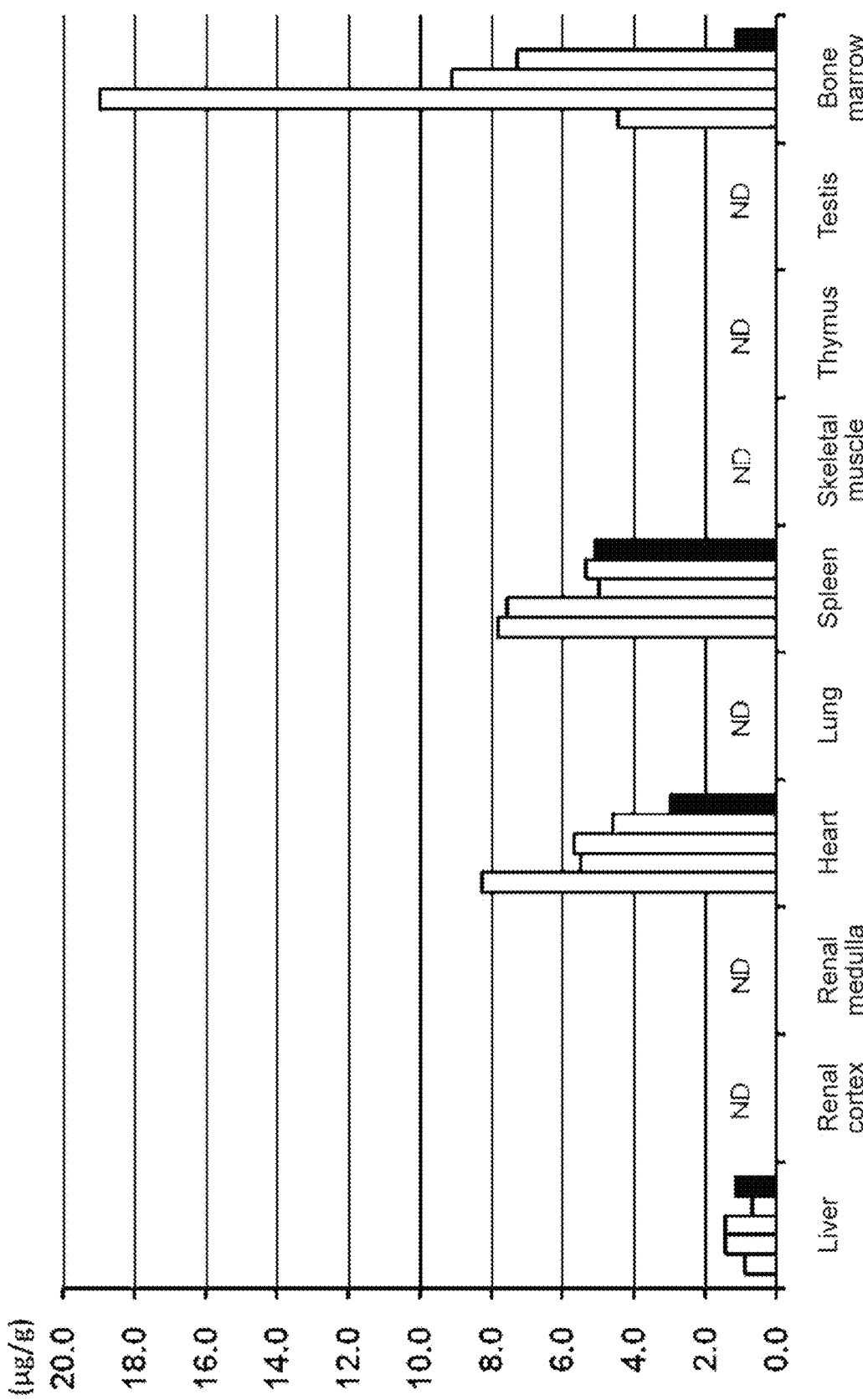
FIG. 4 A figure showing the amount of a humanized anti-hTfR antibody accumulated in various organs other than the brain of a crab-eating monkey after a single intravenous administration. The vertical axis indicates the amount of the humanized anti-hTfR antibody (μg/g wet weight) per wet weight of each organ. The white bars represent, from the left, the amount accumulated in each organ of the monkey after administration of humanized anti-hTfR antibody No.3, humanized anti-hTfR antibody No.3-2, humanized anti-hTfR antibody No.3 (IgG4), and humanized anti-hTfR antibody No.3-2 (IgG4), respectively, and the black bars represent the amount accumulated in respective organs of the monkey after administration of trastuzumab (Herceptin™). "ND" denotes "not detected".

Then, FIG. 4 shows the result of measurement of the concentration of the humanized anti-hTfR antibodies in the tissues of the liver, heart, spleen and bone marrow. The four humanized anti-hTfR antibodies, as well as the negative control, trastuzumab, were observed to accumulate in the liver and spleen, and their amount accumulated was equal between the four humanized anti-hTfR antibodies and trastuzumab. In the heart, the humanized anti-hTfR antibodies tended to accumulate more than trastuzumab, the negative control, but the amount was only about 1.5 to 2.8 times that of the negative control. In bone marrow, the humanized anti-hTfR antibodies tended to accumulate markedly more than trastuzumab, the negative control, and the amount was 3.5 to 16 times that of the negative control. The cause of this accumulation of the humanized anti-hTfR antibodies in bone marrow is thought to be that TfR is expressed at high levels in bone marrow, hematopoietic organ, and more humanized anti-hTfR antibodies, therefore, accumulate through binding to TfR, than the negative control. These data indicate that the four humanized anti-hTfR antibodies has a property that allows them to specifically accumulate the cerebrum, cerebellum, hippocampus and medulla oblongata, which constitute the central nervous system, and that it is now possible to let pharmaceutical agents which need to be brought into function in the brain tissues efficiently accumulate there, by binding such pharmaceutical agents to one of these antibodies.

Then, Table 9-2 shows the result of pharmacokinetic measurement of the humanized anti-hTfR antibodies in the blood. As that of the negative control, trastuzumab, the blood concentration of the four humanized anti-hTfR antibodies was maintained at high levels, higher than 60 μg/mL, even eight hours after administration, indicating that they are stable in the blood (Table 9-2).

TABLE 9-2

Pharmacokinetics of humanized anti-hTfR antibodies in blood (μg/mL blood )

| Antibody No. | Time after administration | | | | |
|---|---|---|---|---|---|
| | 2 min | 30 min | 2 hr | 4 hr | 8 hr |
| 3 | 173 | 147 | 128 | 117 | 97.5 |
| 3-2 | 124 | 99.5 | 78.5 | 76.5 | 61 |
| 3(IgG4) | 141 | 113 | 99 | 95 | 83 |
| 3-2(IgG4) | 132 | 111 | 98.5 | 99 | 95.5 |
| Negative control | 124 | 92.5 | 96 | 75.5 | 60.5 |

Immunohistochemical staining of the humanized anti-hTfR antibodies in brain tissues was performed by the method described in Example 8. However, in doing this, Human IgG-heavy and light chain Antibody (Bethyl Laboratories Inc.) was used in place of Mouse IgG-heavy and light chain Antibody (Bethyl Laboratories Inc.).

Figure 5:
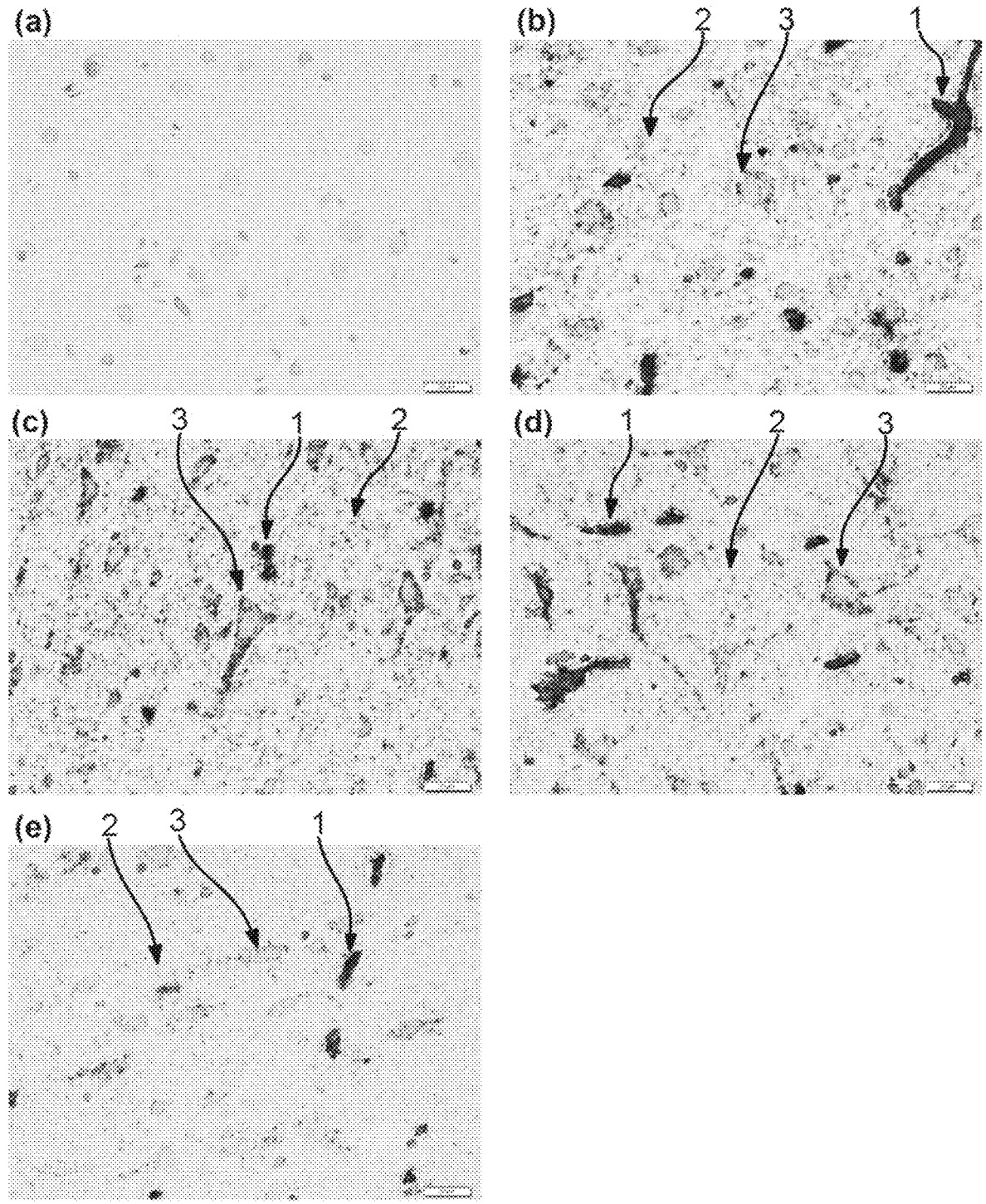
FIG. 5 Substitute photographs for drawings showing the result of immunohistochemical staining of a humanized anti-hTfR antibody in the cerebral cortex of a crab-eating monkey after a single intravenous administration. (a) Herceptin administered, (b) humanized anti-hTfR antibody No.3 administered, (c) humanized anti-hTfR antibody No.3-2 administered, (d) humanized anti-hTfR antibody No.3 (IgG4) administered, (e) humanized anti-hTfR antibody No.3-2 (IgG4) administered. The bar at the bottom right in each photograph is a 20-μm gauge.

FIG. 5 shows the result of immunohistochemical staining of the humanized anti-hTfR antibodies in the cerebral cortex. Specific staining of blood vessels and nerve-like cells were observed in the cerebral cortex of the monkeys administered with humanized anti-hTfR antibody No.3, humanized anti-hTfR antibody No.3-2, humanized anti-hTfR antibody No.3 (IgG4), and humanized anti-hTfR antibody No.3-2 (IgG4) (FIG. 5b-e, respectively). In the cerebral cortex of the monkey administered with humanized anti-hTfR antibody No.3-2, in particular, (FIG. 5c), the brain parenchyma region, outside the blood vessels, was also observed specifically stained extensively. Besides, no staining was observed in the cerebral cortex of the monkey administered with Herceptin as a control, indicating that the tissue staining observed in FIG. 5b-e was specific for the humanized anti-hTfR antibodies (FIG. 5a).

Figure 6:
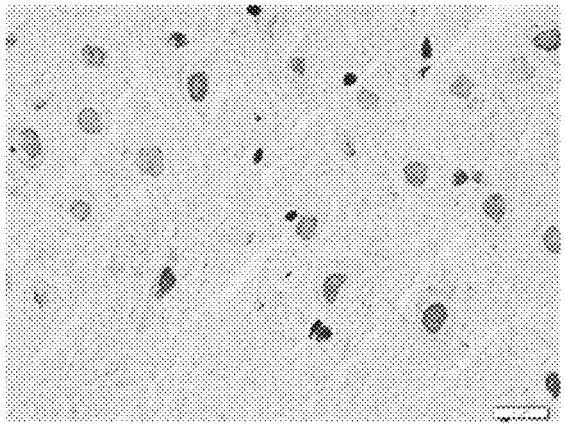
FIG. 6 Substitute photographs for drawing showing the result of immunohistochemical staining of a humanized anti-hTfR antibody in the hippocampus of a crab-eating monkey after a single intravenous administration. (a) Herceptin administered, (b) humanized anti-hTfR antibody No.3 administered, (c) humanized anti-hTfR antibody No.3-2 administered, (d) humanized anti-hTfR antibody No.3 (IgG4) administered, (e) humanized anti-hTfR antibody No.3-2 (IgG4) administered. The bar at the bottom right at each photograph is a 20-μm gauge.
Figure 6:
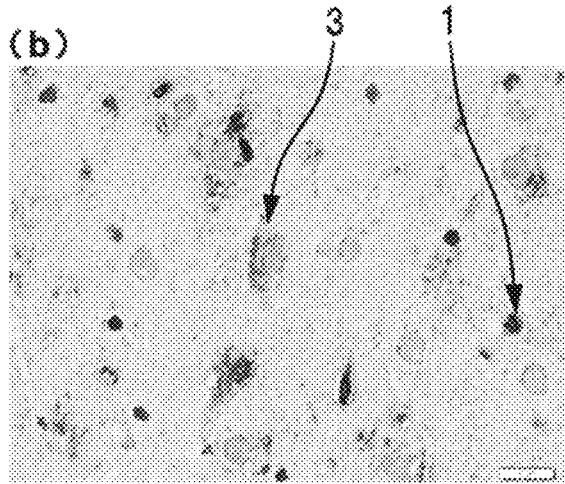
Figure 6:
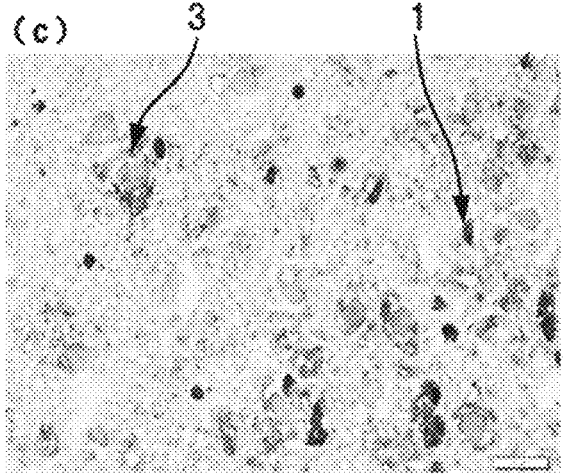
Figure 6:
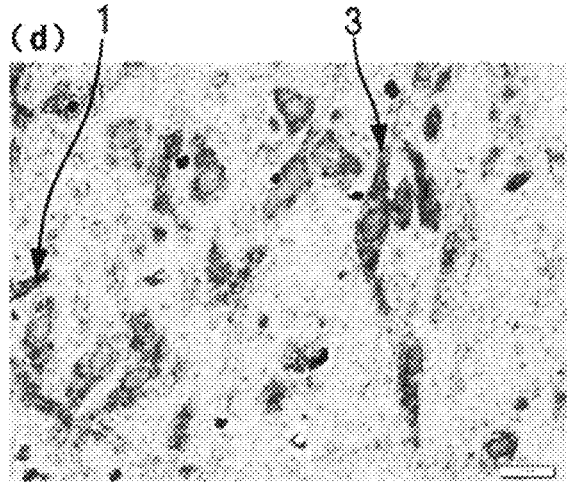
Figure 6:
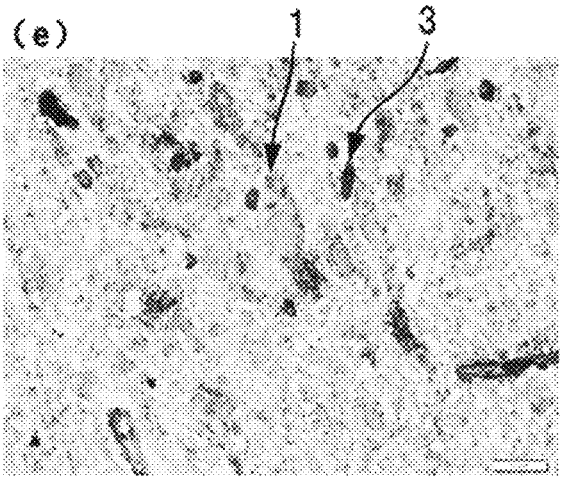

FIG. 6 shows the result of immunohistochemical staining of the humanized anti-hTfR antibodies in the hippocampus. Specific staining of blood vessels and nerve-like cells were observed in the hippocampus of the monkeys administered with humanized anti-hTfR antibody No.3, humanized anti-hTfR antibody No.3-2, humanized anti-hTfR antibody No.3 (IgG4), and humanized anti-hTfR antibody No.3-2 (IgG4) (FIG. 6b-e, respectively). Besides, no staining was observed in the hippocampus of the monkey administered with Herceptin as a control, indicating that the tissue staining observed in FIG. 6b-e was specific for the humanized anti-hTfR antibodies (FIG. 6a).

Figure 7:
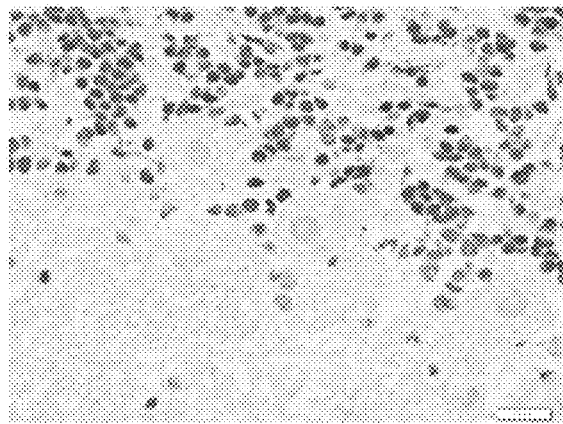
FIG. 7 A figure showing the result of immunohistochemical staining of humanized anti-hTfR antibody in the cerebellum of a crab-eating monkey after a single intravenous administration. (a) Herceptin administered, (b) humanized anti-hTfR antibody No.3 administered, (c) humanized anti-hTfR antibody No.3-2 administered, (d) humanized anti-hTfR antibody No.3 (IgG4) administered, (e) humanized anti-hTfR antibody No.3-2 (IgG4) administered. The bar at the bottom right at each photograph is a 20-μm gauge.
Figure 7:
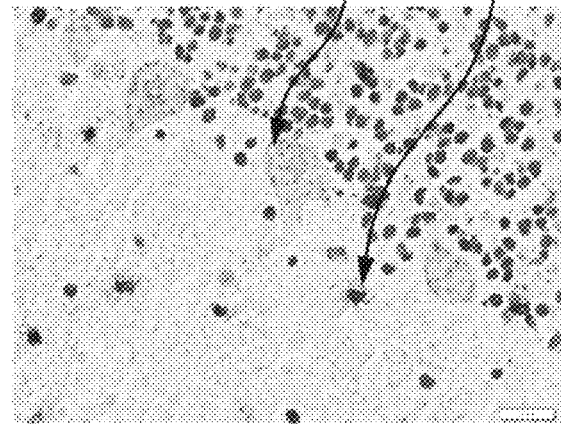
Figure 7:
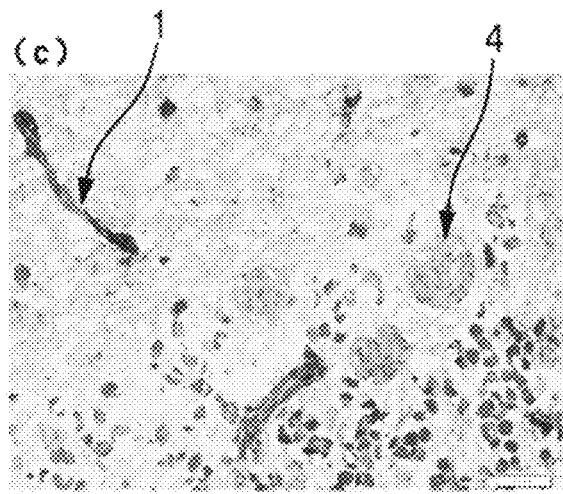
Figure 7:
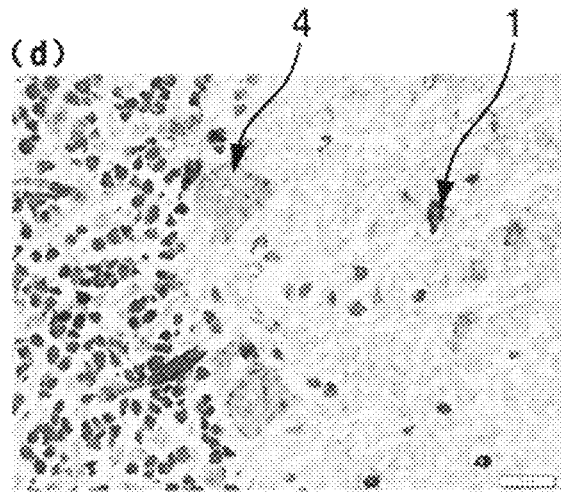
Figure 7:
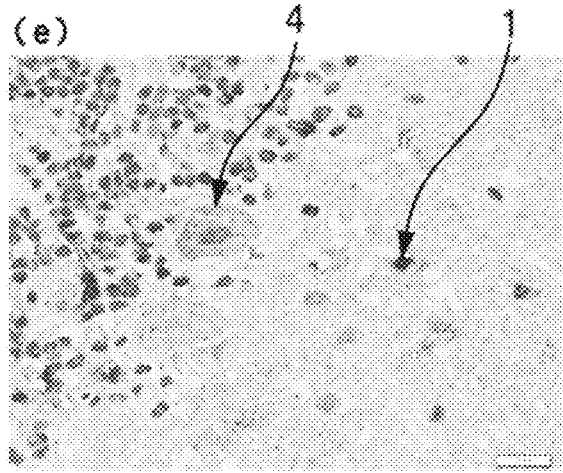

FIG. 7 shows the result of immunohistochemical staining of the humanized anti-hTfR antibodies in the cerebellum. Specific staining of blood vessels and Purkinje cells were observed in the cerebellum of the monkeys administered with humanized anti-hTfR antibody No.3, humanized anti-hTfR antibody No.3-2, humanized anti-hTfR antibody No.3 (IgG4), and humanized anti-hTfR antibody No.3-2 (IgG4) (FIG. 7b-e, respectively). Besides, no staining was observed in the cerebellum of the monkey administered with Herceptin as a control, indicating that the tissue staining observed in FIG. 7b-e was specific for the humanized anti-hTfR antibodies (FIG. 7a).

Figure 8:
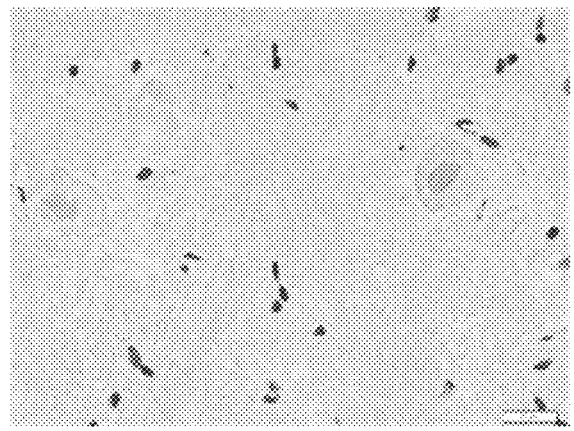
FIG. 8 A figure showing the result of immunohistochemical staining of humanized anti-hTfR antibody in the medulla oblongata of a crab-eating monkey after a single intravenous administration. (a) Herceptin administered, (b) humanized anti-hTfR antibody No.3 administered, (c) humanized anti-hTfR antibody No.3-2 administered, (d) humanized anti-hTfR antibody No.3 (IgG4) administered, (e) humanized anti-hTfR antibody No.3-2 (IgG4) administered. The bar at the bottom right at each photograph is a 20-μm gauge.
Figure 8:
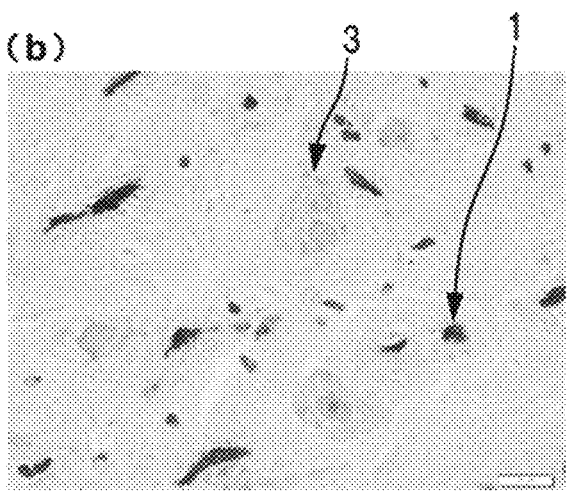
Figure 8:
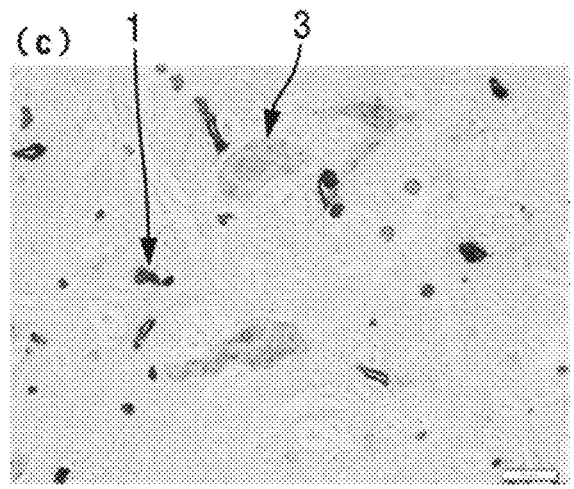
Figure 8:
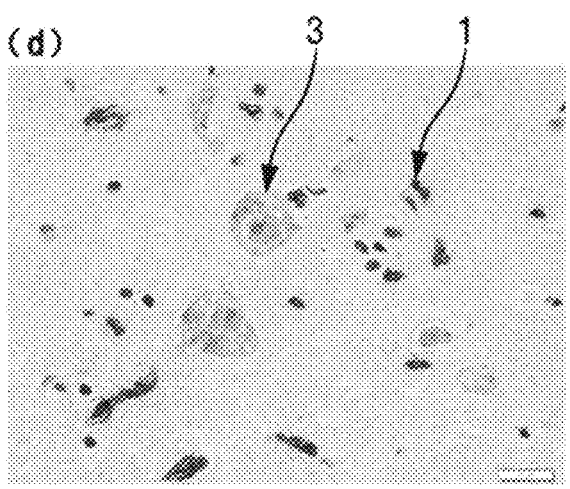
Figure 8:
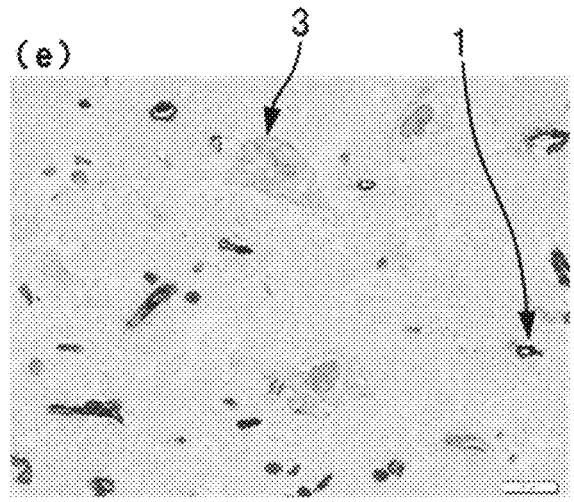

FIG. 8 shows the result of immunohistochemical staining of the humanized anti-hTfR antibodies in the medulla oblongata. Specific staining of blood vessels and nerve-like cells were observed in the medulla oblongata of the monkeys administered with humanized anti-hTfR antibody No.3, humanized anti-hTfR antibody No.3-2, humanized anti-hTfR antibody No.3(IgG4), and humanized anti-hTfR antibody No.3-2 (IgG4) (FIG. 8b-e, respectively). Besides, no staining was observed in the medulla oblongata of the monkey administered with Herceptin as a control, indicating that the tissue staining observed in FIG. 8b-e was specific for the humanized anti-hTfR antibodies (FIG. 8a).

From the result of immunohistochemical staining of the cerebrum and cerebellum in Example 8 above, it was shown that anti-hTfR antibody No. 3, pre-humanized mouse antibodies, can bind to hTfR occurring on the endothelium of blood vessel in the brain, and after binding to hTfR, pass through the blood-brain barrier into the brain parenchyma, and further be taken up into the brain parenchyma and nerve-like cell in the hippocampus, and into Purkinje cells in the cerebellum.

From the result of immunohistochemical staining in the cerebrum, hippocampus, cerebellum, and medulla oblongata in Example 15, it was revealed that the tested four humanized anti-hTfR antibodies obtained by humanizing anti-hTfR antibody No.3 subjected to the experiment can bind to hTfR occurring on the endothelium of blood vessels of the brain, and after binding to hTfR, pass through the blood-brain barrier and transfer into the brain parenchyma, and further, be taken up into nerve-like cells in the cerebral cortex; into the brain parenchyma and the nerve-like cells in the hippocampus; into Purkinje cells in the cerebellum; and into nerve-like cells in the medulla oblongata.

Example 16

Introduction of Mutation to Heavy Chain of Humanized Anti-hTfR Antibody No. 3

In the heavy chain variable region of humanized anti-hTfR antibody No. 3 set forth as SEQ ID NO: 37, when CDR1 was the one set forth as SEQ ID NO: 12, one amino acid in the amino acid sequence of the CDR1 was replaced with another amino acid while one amino acid in the amino acid sequence of framework region 3 was replaced with another amino acid to produce a heavy chain of the humanized antibody. The heavy chain of this new antibody comprises the amino acid sequence set forth as SEQ ID NO: 62 or 63 in CDR1 and comprises the amino acid sequence set forth as SEQ ID NO: 64 in framework region 3, as a result of replacing the two amino acids constituting the amino acid sequence of the heavy chain of humanized anti-hTfR antibody No. 3 set forth in SEQ ID NO: 37. The heavy chain of this new antibody (the heavy chain of humanized anti-hTfR antibody No. 3N) comprises the amino acid sequence set forth as SEQ ID NO: 66, and the variable region in the amino acid sequence comprises the amino acid sequence set forth as SEQ ID NO: 65.

Table 10 shows alignment between CDR1 set forth as SEQ ID NO: 12 in the heavy chain of humanized anti-hTfR antibody No. 3 and CDR1 set forth as SEQ ID NO: 62 in the heavy chain of humanized anti-hTfR antibody No. 3N. In the alignment, the amino acid threonine at position 5 from the N-terminal side was replaced with methionine.

Table 11 shows alignment between the framework region 3 (SEQ ID NO: 73) in the heavy chain of humanized anti-hTfR antibody No. 3 and the framework region 3 (SEQ ID NO: 64) in the heavy chain of humanized anti-hTfR antibody No. 3N. In the alignment, the amino acid tryptophan at position 17 from the N-terminal side was replaced with leucine.

TABLE 10

Alignment of amino acid sequence of CDR1

|  | CDR1 |
| --- | --- |
| Humanized anti-hTfR antibody No. 3 | GYSFTNYW |
|  | **** *** |
| Humanized anti-hTfR antibody No. 3N | GYSFMNYW |

* represents identical amino acids.

TABLE 11

Alignment of amino acid sequence of framework region

|  | FR3 |
| --- | --- |
| Humanized anti-hTfR antibody No. 3 | QVTISADKSISTAYLQWSSLKASDTAMYYC |
|  | *************** ************* |
| Humanized anti-hTfR antibody No. 3N | QVTISADKSISTAYLQLSSLKASDTAMYYC |

* represents identical amino acids.

Example 17

Construction of Cells for Expression of Humanized Anti-hTfR Antibody No. 3N

A DNA fragment (SEQ ID NO: 67) was artificially synthesized, which included a gene encoding the antibody heavy chain consisting of the amino acid sequence set forth as SEQ ID NO: 66. This DNA fragment was added, on its 5' side, a MluI sequence and a sequence encoding a leader peptide in this order from the 5' end, and a NotI sequence on its 3' side. The DNA thus synthesized was inserted into the vector pE-neo by the method described in Example 11, and the vector thus obtained was used as an expression vector for the heavy chain of humanized anti-hTfR antibody No. 3N, pE-neo(HC3)N. CHO cells were transformed by the method described in Example 12 using this pE-neo(HC3)N and the vector for light chain expression, pE-hygr(LC3), constructed in Example 11, to obtain a humanized anti-hTfR antibody No. 3N expressing cell line.

Example 18

Purification of Humanized Anti-hTfR Antibody No. 3N

A purified product of humanized anti-hTfR antibody No. 3N was obtained by the method described in Example 13 using the humanized anti-hTfR antibody No. 3N expressing cell line obtained in Example 17. Besides, humanized anti-hTfR antibody No. 3N has the substitution of two amino acids shown in Table 10 and Table 11 in the amino acid sequence of the heavy chain of humanized anti-hTfR antibody No. 3. On the other hand, the light chains of humanized anti-hTfR antibody No. 3N and humanized anti-hTfR antibody No. 3 have identical amino acid sequences.

Example 19

Comparison of Affinity to Human TfR and Monkey TfR Between Humanized Anti-hTfR Antibody No. 3 and Humanized Anti-hTfR Antibody No. 3N The affinity of humanized anti-hTfR antibody No. 3 obtained in Example 13 and humanized anti-hTfR antibody No. 3N obtained in Example 17 to human TfR and human TfR was measured by the method described in Example 7. Table 12 shows the results of measurement of association rate constant (kon), dissociation rate constant (koff) of each antibody, and dissociation constant ($k_D$) to human TfR. Besides, the measurement indicating the affinity of humanized anti-hTfR antibody No. 3 to human TfR differed from that shown in Table 6, but is an experimental error.

TABLE 12

Affinity of humanized anti-hTfR antibody for human TfR

|  | kon ($M^{-1}s^{-1}$) | koff ($s^{-1}$) | $K_D$ (M) |
| --- | --- | --- | --- |
| Humanized anti-hTfR antibody 3 | $8.47 \times 10^5$ | $<1.0 \times 10^{-7}$ | $<1.0 \times 10^{-12}$ |
| Humanized anti-hTfR antibody 3N | $7.84 \times 10^5$ | $<1.0 \times 10^{-7}$ | $<1.0 \times 10^{-12}$ |

The affinity of humanized anti-hTfR antibody No. 3 obtained in Example 13 and humanized anti-hTfR antibody No. 3N obtained in Example 17 to human TfR and monkey TfR was measured by the method described in Example 7. Table 13 shows the results of measurement of association rate constant (kon), dissociation rate constant (koff) of each antibody, and dissociation constant ($k_D$) to monkey TfR. Besides, the measurement indicating the affinity of humanized anti-hTfR antibody No. 3 to monkey TfR differed from that shown in Table 7, but is an experimental error.

TABLE 13

Affinity of humanized anti-hTfR antibody for monkey TfR

|  | kon ($M^{-1}s^{-1}$) | koff ($s^{-1}$) | $K_D$ (M) |
| --- | --- | --- | --- |
| Humanized anti-hTfR antibody 3 | $6.09 \times 10^5$ | $8.06 \times 10^{-4}$ | $1.32 \times 10^{-9}$ |
| Humanized anti-hTfR antibody 3N | $3.86 \times 10^5$ | $1.96 \times 10^{-5}$ | $5.07 \times 10^{-11}$ |

When $K_D$ with monkey TfR was compared between humanized anti-hTfR antibody No. 3N and humanized anti-hTfR antibody No. 3, the former was $5.07 \times 10^{-11}$ M and the latter was $1.32 \times 10^{-9}$ M; thus $K_D$ of humanized anti-hTfR antibody No. 3N with monkey TfR was approximately 1/30 of that of humanized anti-hTfR antibody No. 3. On the other hand, when Kd with human TfR was compared between humanized anti-hTfR antibody No. 3N and humanized anti-hTfR antibody No. 3, both were less than $1 \times 10^{-12}$ M; thus both the antibodies had a high affinity to human TfR. Also, both the antibodies have a higher affinity to human TfR than the affinity to monkey TfR.

As part of nonclinical trials to be conducted to develop humanized anti-hTfR antibodies as pharmaceutical agents, pharmacological tests using monkeys are often carried out. Because results of these pharmacological tests using monkeys are used for judging the validity of clinical trials using humans, it is preferable that behavior in the bodies of monkeys should be closer to behavior in the bodies of humans. As shown in the above results, humanized anti-hTfR antibody No. 3N exhibits approximately 30 times higher affinity to monkey TfR than that of humanized anti-hTfR antibody No. 3, and the behavior of humanized anti-hTfR antibody No. 3N in the bodies of monkeys can therefore be regarded as being closer to its behavior in the bodies of humans. Thus, by using humanized anti-hTfR antibody No. 3N, results more reflecting behavior in the bodies of humans are obtained in tests using monkeys. Thus, more beneficial results for making a decision to conduct clinical trials using humans are obtained by the tests using monkeys.

Example 20

Comparison of Transfer to Brain Tissue in Monkey Between Humanized Anti-hTfR Antibody No. 3 and Humanized Anti-hTfR Antibody No. 3N Each of humanized anti-hTfR antibody No. 3 obtained in Example 13 and humanized anti-hTfR antibody No. 3N obtained in Example 17 was intravenously administered once to a male crab-eating monkey at a dosage of 5.0 mg/kg, and 8 hours after the administration, whole body irrigation was carried out. After the irrigation, the brain and spine tissues including the medulla oblongata were excised. The brain tissues thus excised were separated into the cerebral cortex, the cerebellum, the hippocampus and the medulla oblongata.

Measurement of the concentration of humanized anti-hTfR antibodies contained in each tissue was carried out in accordance with the measurement method described in Example 15.

The result of the concentration measurement of the anti-hTfR antibodies in brain tissues is shown in Table 14. When the concentration in the cerebrum, the cerebellum, and the hippocampus was compared between humanized anti-hTfR antibody No. 3N and humanized anti-hTfR antibody No. 3, the concentration of humanized anti-hTfR antibody No. 3N was approximately 1.42 times in the cerebrum, approximately 1.56 times in the cerebellum, and approximately 1.29 times in the hippocampus, higher than that of humanized anti-hTfR antibody No. 3. In the medulla oblongata, their concentrations were almost equal. In the cervical spine as well, the concentration of humanized anti-hTfR antibody No. 3N was approximately 1.47 times higher than that of humanized anti-hTfR antibody No. 3. These results demonstrate that humanized anti-hTfR antibody No. 3N, compared with humanized anti-hTfR antibody No. 3, had a property to more efficiently pass through the blood brain barrier and accumulate in the brain tissues of the cerebrum, the cerebellum, the hippocampus, and the like. Namely, the results show that by binding these antibodies to a pharmaceutical agent which needs to be brought into function in the brain tissues, humanized anti-hTfR antibody No. 3N had a property to let those pharmaceutical agents efficiently accumulate in the brain tissues.

TABLE 14

| Antibody No. | Concentration of anti-hTfR antibody in brain tissue (µg/g wet weight) | | | | |
|---|---|---|---|---|---|
| | Cerebrum | Cerebellum | Hippo-campus | Medulla oblongata | Cervical cord |
| 3 | 0.670 | 0.610 | 0.490 | 0.589 | 0.589 |
| 3N | 0.953 | 0.950 | 0.631 | 0.586 | 0.672 |

Example 20-2

Preparation of Cells for Expression of hFc-Humanized Anti-hTfR Antibody

A DNA fragment (SEQ ID NO: 72) was artificially synthesized, which included a gene encoding the amino acid sequence of the human IgG Fc region-added humanized anti-hTfR antibody 3N Fab heavy chain consisting of the amino acid sequence set forth as SEQ ID NO: 71. This DNA fragment was added, on its 5' side, a MluI sequence and a sequence encoding a leader peptide in this order from the 5' end, and a NotI sequence on its 3' side. The DNA thus synthesized was inserted into the vector pE-neo by the method described in Example 11, and the vector thus obtained was designated as pE-neo(Fc-Fab HC(3N)). CHO cells were transformed by the method described in Example 12 using this pE-neo(Fc-Fab HC(3N)) and the vector for light chain expression, pE-hygr(LC3), constructed in Example 11, to obtain a Fc-Fab(3N) expressing cell line.

Example 20-3

Preparation of hFc-Humanized Anti-hTfR Antibody

A purified product of Fc-Fab(3N) was obtained by the method described in Example 13 using the Fc-Fab(3N) expressing cell line.

Example 20-4

Comparison of Affinity of hFc-Humanized Anti-hTfR Antibody Between Human TfR and Monkey TfR The affinity of the purified product of Fc-Fab(3N) obtained in Example 20-3 to human TfR and monkey TfR was measured by the method described in Example 7. The results are shown in Table 14-2. Fc-Fab (3N) exhibited a high affinity ($K_D < 1.0 \times 10^{-12}$) to human TfR. These results indicate that Fc-Fab (3N) has a property that enables pharmaceutical agents which need to be brought into function in brain tissues to efficiently accumulate in the brain tissues, by binding such pharmaceutical agents to one of these antibodies.

[Table 14-2]

TABLE 14-2

| Affinity of hFc-humanized anti-hTfR antibody for human TfR and monkey TfR | | | |
|---|---|---|---|
| | kon ($M^{-1}s^{-1}$) | koff ($s^{-1}$) | $K_D$ (M) |
| Human TfR | $6.67 \times 10^5$ | $<1.0 \times 10^{-7}$ | $<1.0 \times 10^{-12}$ |
| Monkey TfR | $2.43 \times 10^5$ | $2.09 \times 10^{-4}$ | $8.61 \times 10^{-10}$ |

Example 20-5

Measurement of Transfer of hFc-Humanized Anti-hTfR Antibody into Brain Tissues in Monkey The Fc-Fab (3N) obtained in Example 20-3 was intravenously administered once to a male crab-eating monkey at a dosage of 5.0 mg/kg, and 8 hours after the administration, whole body irrigation was carried out. After the irrigation, the brain and spine tissues including the medulla oblongata were excised. The brain tissues thus excised were separated into the cerebral cortex, the cerebellum, the hippocampus and the medulla oblongata.

Measurement of the concentration of humanized anti-hTfR antibodies contained in each tissue was carried out in accordance with the measurement method described in Example 15.

The result of the concentration measurement of the anti-hTfR antibodies in brain tissues is shown in Table 14-3. The concentrations of Fc-Fab (3N) in the cerebrum, the cerebellum, and the hippocampus were 0.80 µg/g in terms of a wet weight, 0.80 µg/g in terms of a wet weight and 1.05 µg/g, respectively. The concentrations in the medulla oblongata and the spinal cord were 0.68 µg/g in terms of a wet weight and 0.67 µg/g in terms of a wet weight, respectively. These results indicate that the anti-hTfR antibody can pass through BBB even when the humanized anti-hTfR antibody which is Fab is bound, on the N-terminal side thereof, to the Fc region. When a conjugate in which a desired substance (protein or physiologically active substance) is bound to Fab is intravitally administered and is instable, Fab is bound, on the N-terminal side thereof, to the Fc region, whereby it is possible to stabilize such a conjugate in the body, e.g. increase the blood half-life of the conjugate while maintaining the property of passing through BBB.

TABLE 14-3

Concentration of hFc-humanized anti-hTfR antibody in brain tissues (µg/g wet weight)

| | Cerebrum | Cerebellum | Hippocampus | Medulla oblongata | Cervical cord |
|---|---|---|---|---|---|
| hFc-humanized anti-hTfR antibody | 0.80 | 0.80 | 1.05 | 0.67 | 0.68 |

Example 21

Preparation of hI2S-Humanized Anti-hTfR Antibody Fusion Protein Expression Cells A DNA fragment was artificially synthesized having the nucleotide sequence set forth as SEQ ID NO:52, which included a gene encoding a protein in which the humanized anti-hTfR antibody No. 3 heavy chain having the amino acid sequence set forth as SEQ ID NO:51 was linked, on the C-terminal side thereof and via a linker sequence (Gly Ser), to hI2S having the amino acid sequence set forth as SEQ ID NO:50. This DNA fragment encoded a protein in which humanized anti-hTfR antibody heavy chain having the amino acid sequence set forth as SEQ ID NO:247 was linked, via a linker sequence (Gly Ser), to hI2S. This DNA fragment had, on its 5' side, a MluI sequence, and a sequence encoding a leader peptide acting as a secretion signal in this order from the 5' end, and a NotI sequence on its 3' side. The DNA fragment was digested with MluI and NotI, and inserted into the vector pE-neo, between the MluI and NotI thereof, to construct pE-neo(HC-I2S-1).

A DNA fragment was artificially synthesized having the nucleotide sequence set forth as SEQ ID NO:54, which included a gene encoding a protein in which the heavy chain of the humanized anti-hTfR antibody No. 3N having the amino acid sequence set forth as SEQ ID NO:66 was linked, on the C-terminal side thereof and via a linker sequence (Gly Ser), to hI2S having the amino acid sequence set forth as SEQ ID NO:50. This DNA fragment encoded a protein in which humanized anti-hTfR antibody heavy chain having the amino acid sequence set forth as SEQ ID NO:53 was linked, via a linker sequence (Gly Ser), to hI2S. This DNA fragment had, on its 5' side, a MluI sequence and a sequence encoding a leader peptide acting as a secretion signal in this order from the 5' end, and a NotI sequence on its 3' side. The DNA fragment was digested with MluI and NotI, and inserted into the vector pE-neo, between the MluI and NotI thereof, to construct pE-neo(HC-I2S-2).

CHO cells (CHO-K1: purchased from American Type Culture Collection) were transformed with pE-neo(HC-I2S-3) and pE-hygr(LC3) which had been prepared in Example 11, to obtain a cell line expressing a fusion protein between hI2S and a humanized anti-hTfR antibody. This cell line was designated hI2S-anti-hTfR antibody expressing cell line 3. The fusion protein between hI2S and a humanized anti-hTfR antibody expressed by the cell lines was designated I2S-anti-hTfR antibody 3.

CHO cells were transformed with pE-neo(HC-I2S-3N) and pE-hygr(LC3) to obtain a cell line expressing a fusion protein between hI2S and a humanized anti-hTfR antibody. This cell line was designated as hI2S-anti-hTfR antibody expressing cell line 3N. The fusion protein between hI2S and a humanized anti-hTfR antibody expressed by the cells was designated as I2S-anti-hTfR antibody 3N.

Example 22

Production of I2S-Anti-hTfR Antibodies

I2S-anti-hTfR antibodies were produced by the following method. With CD OptiCHO™ medium, hI2S-anti-hTfR antibody expressing cell lines 3 and 3N obtained in Example 21 were diluted to the density of approximately $2 \times 10^5$ cells/mL, respectively. The cell suspensions, 200 mL, were added to corresponding 1 L-conical flasks, and cultured for 6 to 7 days in a wet environment of 37° C., 5% $CO_2$, 95% air with stirring at a rate of about 70 rpm. Each culture supernatant was collected by centrifugation, and filtered through a 0.22 µm filter (Millipore Inc.) to prepare the culture supernatant. To each culture supernatant thus obtained was added five column volumes of 20 mM Tris buffer (pH 8.0) containing 150 mL NaCl, and loaded onto a Protein A column (column volume: 1 mL, Bio-Rad Inc.) which had been equilibrated in advance with three column volumes of 20 mM Tris buffer (pH 8.0) containing 150 mM NaCl. Then, the column was washed with five column volumes of the same buffer, and the adsorbed I2S-anti-hTfR antibody was eluted with four column volumes of 50 mM glycine buffer (pH 2.8) containing 150 mM NaCl. The pH of the eluate containing I2S-anti-hTfR antibody was adjusted to pH 7.0 with 1 M Tris buffer (pH 8.0), and then the buffer was replaced with PBS buffer using Amicon Ultra 30 kDa membrane (Millipore Inc.) to obtain purified products of I2S-anti-hTfR antibody 3 and I2S-anti-hTfR antibody 3N.

Example 23

Measurement of Affinity of I2S-Anti-hTfR Antibody to Human TfR and Monkey TfR

The affinity of the I2S-anti-hTfR antibodies obtained in Example 22 to human TfR and monkey TfR was measured in accordance with the method described in Example 7. Table 15 shows the results of measurement of association rate constant (kon), dissociation rate constant (koff) of I2S-anti-hTfR antibody 3 and I2S-anti-hTfR antibody 3N, and dissociation constant ($k_D$) to human TfR. Table 16 shows the results of measurement of association rate constant (kon), dissociation rate constant (koff) of I2S-anti-hTfR antibody 3 and I2S-anti-hTfR antibody 3N, and dissociation constant ($k_D$) to monkey TfR.

I2S-anti-hTfR antibody 3N exhibited approximately 5 times the affinity of I2S-anti-hTfR antibody to human TfR (Table 15). Further, I2S-anti-hTfR antibody 3N exhibited a much higher affinity to monkey TfR than that of I2S-anti-hTfR antibody (Table 16). I2S-anti-hTfR antibody 3N exhibited a higher affinity to human TfR and monkey TfR, than that of I2S-anti-hTfR antibody 3.

TABLE 15

Affinity of I2S-anti-hTfR antibody to human TfR

| | kon (M$^{-1}$s$^{-1}$) | koff (s$^{-1}$) | K$_D$ (M) |
|---|---|---|---|
| I2S-anti-hTfR antibody 3 | 8.29 × 10$^5$ | 1.04 × 10$^{-4}$ | 1.26 × 10$^{-10}$ |
| I2S-anti-hTfR antibody 3N | 6.92 × 10$^5$ | 1.90 × 10$^{-5}$ | 2.75 × 10$^{-11}$ |

TABLE 16

Affinity of I2S-anti-hTfR antibody to monkey TfR

| | kon (M$^{-1}$s$^{-1}$) | koff (s$^{-1}$) | K$_D$ (M) |
|---|---|---|---|
| I2S-anti-hTfR antibody 3 | 3.77 × 10$^5$ | 4.10 × 10$^{-4}$ | 1.09 ×× 10$^{-9}$ |
| I2S-anti-hTfR antibody 3N | 3.83 × 10$^5$ | <1.00 × 10$^{-7}$ | <1.00 × 10$^{-12}$ |

Example 24

Comparison of Transfer to Brain Tissue in Monkey Between I2S-Anti-hTfR Antibody 3 and I2S-Anti-hTfR Antibody 3N Each of I2S-anti-hTfR antibody 3 and I2S-anti-hTfR antibody 3N obtained in Example 22 was intravenously administered once to a male crab-eating monkey at a dosage of 5.0 mg/kg, and 8 hours after the administration, whole body irrigation was carried out. After the irrigation, the brain and spine tissues including the medulla oblongata were excised. The brain tissues thus excised were separated into the cerebral cortex, the cerebellum, the hippocampus and the medulla oblongata.

Measurement of the concentration of I2S-anti-hTfR antibodies contained in each tissue was carried out largely following the procedure described in Example 20. The result of the concentration measurement of the I2S-anti-hTfR antibodies in brain tissues is shown in Table 17. When the concentration in the cerebrum, the cerebellum, the hippocampus, the medulla oblongata, and the cervical spine was compared between I2S-anti-hTfR antibody 3N and I2S-anti-hTfR antibody 3, the concentration of I2S-anti-hTfR antibody 3N was approximately 2.12 times in the cerebrum, approximately 1.97 times in the cerebellum, approximately 2.41 times in the hippocampus, 1.94 times in the medulla oblongata, and 1.63 times in the cervical spine, higher than that of I2S-anti-hTfR antibody 3. This result demonstrates that I2S-anti-hTfR antibody 3N can pass through the blood-brain barrier more efficiently than I2S-anti-hTfR antibody 3.

TABLE 17

| | Concentration of I2S-anti-hTfR antibody in brain tissue (μg/g wet weight) | | | | |
|---|---|---|---|---|---|
| | Cerebrum | Cerebellum | Hippocampus | Medulla oblongata | Cervical cord |
| I2S-anti-hTfR antibody 3 | 0.224 | 0.249 | 0.183 | 0.229 | 0.188 |
| I2S-anti-hTfR antibody 3N | 0.475 | 0.491 | 0.441 | 0.450 | 0.306 |

Example 25

Preparation of Cells for Expression of hGAA-Humanized Anti-hTfR Antibody Fusion Protein A DNA fragment was artificially synthesized having the nucleotide sequence set forth as SEQ ID NO:59, which included a gene encoding a protein in which the heavy chain of the humanized anti-hTfR antibody 3N having the amino acid sequence set forth as SEQ ID NO:68 was linked, on the C-terminal side thereof and via a linker sequence (Gly Ser), to hGAA having the amino acid sequence set forth as SEQ ID NO:55. This DNA fragment encoded a protein in which the heavy chain (IgG4) of the humanized anti-hTfR antibody 3N having the amino acid sequence set forth as SEQ ID NO:58 was linked, via a linker sequence (Gly Ser), to hGAA. This DNA fragment had, on its 5' side, a MluI sequence and a sequence encoding a leader peptide acting as a secretion signal in this order from the 5' end, and a NotI sequence on its 3' side. The DNA fragment was digested with MluI and NotI, and inserted into the vector pE-neo, between the MluI and NotI thereof, to construct pE-neo(HC-GAA-3N(IgG4)).

CHO cells (CHO-K1: purchased from American Type Culture Collection) were transformed with pE-neo(HC-GAA-3N(IgG4)) and pE-hygr(LC3) constructed in Example 11 to obtain a cell line expressing a fusion protein between hGAA and a humanized anti-hTfR antibody. This cell line was designated as hGAA-anti-hTfR antibody expressing cell line 3N(IgG4). The fusion protein between hGAA and a humanized anti-hTfR antibody expressed by the cells was designated as GAA-anti-hTfR antibody 3N(IgG4).

Example 26

Production of GAA-Anti-hTfR Antibody 3N(IgG4)

GAA-anti-hTfR antibody 3N(IgG4) was produced largely following the method described in Example 22 using the hGAA-anti-hTfR antibody expressing cell line 3N(IgG4) obtained in Example 25.

Example 27

Measurement of Affinity of hGAA-Anti-hTfR Antibody 3N (IgG4) to Human TfR and Monkey TfR The affinity of the hGAA-anti-hTfR antibody 3N (IgG4) obtained in Example 26 to human TfR and monkey TfR was measured in accordance with the method described in Example 23. The results of measurement of the affinity of Fab GS-GAA prepared in Example 31 below to human TfR and monkey TfR are also described here.

The hGAA-anti-hTfR antibody 3N (IgG4) exhibited a very high affinity to both human TfR and monkey TfR. The results are shown in Table 17-2. Fab GS-GAA also exhibited a high affinity to both human TfR and monkey TfR, but the affinity was lower than that of the hGAA-anti-hTfR antibody 3N (IgG4).

TABLE 17-2

Affinity of hGAA-anti-hTfR antibody 3N (IgG4) and Fab GS-GAA to human TfR and monkey TfR

| | | kon (1/Ms) | koff (1/s) | $K_D$ (M) |
|---|---|---|---|---|
| hGAA-anti-hTfR antibody 3N (IgG4) | Human TfR | $4.86 \times 10^5$ | $<1.00 \times 10^{-7}$ | $<1.00 \times 10^{-12}$ |
| | Monkey TfR | $2.03 \times 10^5$ | $<1.00 \times 10^{-7}$ | $<1.00 \times 10^{-12}$ |
| Fab GS-GAA | Human TfR | $4.14 \times 10^5$ | $1.67 \times 10^{-4}$ | $4.04 \times 10^{-10}$ |
| | Monkey TfR | $3.29 \times 10^5$ | $5.01 \times 10^{-3}$ | $1.52 \times 10^{-8}$ |

Example 28

Assessment of Transfer of hGAA-Anti-hTfR Antibody 3N (IgG4) into Brain Tissues in Monkey Transfer of the hGAA-anti-hTfR antibody 3N (IgG4) obtained in Example 26 into brain tissues can be assessed in accordance with the method described in Example 24. Specifically, the hGAA-anti-hTfR antibody 3N (IgG4) was intravenously administered once to a male crab-eating monkey at dosages of 5.0 mg/kg and 20 mg/kg. As a control agent, hGAA commercially available as a therapeutic agent for Pompe's disease was intravenously administered once to a male crab-eating monkey at dosages of 5.0 mg/kg and 20 mg/kg. Three monkeys were administered with the hGAA-anti-hTfR antibody 3N (IgG4) at a dosage of 20 mg/kg, and one monkey was administered with the other antibody. The monkeys administered with the hGAA-anti-hTfR antibody 3N (IgG4) at a dosage of 20 mg/kg were each subjected to whole body irrigation with a physiological saline solution (Otsuka Pharmaceutical Co., Ltd.) 4 hours, 8 hours and 24 hours after the administration. The other monkey was subjected to whole body irrigation 8 hours after the administration.

After the irrigation, brain tissues including the medulla oblongata, spinal cord tissues and skeletal muscle tissues were excised. The brain tissues were divided into the cerebral cortex, the cerebellum, the hippocampus, the medulla oblongata and the pontine. For the skeleton muscle tissues, the rectus femoris muscle, the extensor digitorum longus muscle, the soleus muscle, the triceps brachii muscle, the major psoas muscle, the diaphragm and the lingual muscle were excised. One male crab-eating monkey which had not been administered with a pharmaceutical agent was subjected to whole body irrigation with a physiological saline solution (Otsuka Pharmaceutical Co., Ltd.), and the cerebral cortex and the rectus femoris muscle were excised. The excised tissues were homogenized with T-PER (Thermo Fisher Scientific Inc.) containing Protease Inhibitor Cocktail (Sigma Inc.), and centrifuged to collect the supernatant. Using the prepared supernatant, the concentrations of the hGAA-anti-hTfR antibody 3N (IgG4) and hGAA were measured by the following ECL method, and immunohistochemical staining was performed.

Measurement of Concentration of Protein by ECL Method:

A rabbit anti-hGAA polyclonal antibody was SULFO-labeled with MSD GOLD Sulfo-TAG NHS Ester (Meso Scale Discovery Inc.) to prepare a SULFO-labeled anti-hGAA antibody. Further, the rabbit anti-hGAA polyclonal antibody was Biotin-labeled with EZ-Link NHS-PEG4-Biotin (Thermo Fisher Scientific Inc.) to prepare a Biotin-labeled anti-hGAA antibody. A solution of a mixture of equal amounts of the SULFO-labeled anti-hGAA antibody and the Biotin-labeled anti-hGAA antibody was prepared, the supernatant obtained as described above was added to this solution, and the resulting mixture was incubated at room temperature for 1 hour to prepare an antibody reaction sample. A 1% BSA/PBS solution was added to each well of Streptavidin Gold Plate 96well (Meso Scale Diagnostics Inc.) which is a plate coated with streptavidin, and the plate was left standing for 1 hour to block the plate.

After the blocking, each well of the plate was washed with 200 μL of PBS-T (Sigma Inc.), and the antibody reaction sample was then added to each well, and incubated at room temperature for 1 hour. After the incubation, each well of the plate was washed with PBS-T, a mixed liquid of the equal amounts of 4× Read buffer T (Meso scale Diagnostics Inc.) and water for injection (Otsuka Pharmaceutical Co., Ltd.) was then added, and the amount of luminescence from each well was measured using Sector™ Imager 6000 (Meso Scale Diagnostics Inc.). The amount of the antibody contained per one gram brain (wet weight) was calculated by producing a standard curve based on measurements of standard samples containing known concentrations of the hGAA-anti-hTfR antibody 3N (IgG4) or hGAA, and interpolating the measurement of each sample with reference to the standard curve to determine the amounts of the hGAA-anti-hTfR antibody 3N (IgG4) and hGAA.

The results of measurement of the concentrations by an ELC method are shown in Table 18. First, the results for brain tissues will be discussed. In the monkey administered with the hGAA-anti-hTfR antibody 3N (IgG4), the concentrations of the hGAA-anti-hTfR antibody 3N (IgG4) administered at dosages of 5 mg/kg and 20 mg/kg increased in a concentration-dependent manner to 0.740 μg/g in terms of a wet weight and 1.42 μg/g in terms of a wet weight, respectively, in the cerebral cortex 8 hours after the administration. The same results were obtained for the cerebellum, the hippocampus, the medulla oblongata and the pontine. On the other hand, in the monkey administered with hGAA, the concentrations of hGAA administered at dosages of 5 mg/kg and 20 mg/kg showed almost equal values of 0.414 μg/g in terms of a wet weight and 0.435 μg/g in terms of a wet weight, respectively, in the cerebral cortex 8 hours after the administration. The same results were obtained for the cerebellum, the hippocampus, the medulla oblongata and the pontine. In view of the fact that the value of the concentration of intrinsic GAA in the cerebral cortex having the determined amount of hGAA in the monkey which had not been administered with the pharmaceutical agent was 0.425 μg/g in terms of a wet weight, it is apparent that little of intravenously administered hGAA is taken up in the brain. On the other hand, it is apparent that the intravenously administered hGAA-anti-hTfR antibody 3N (IgG4) is taken up in the brain by passing through BBB.

Next, the results for skeletal muscle tissues will be discussed. In the monkey administered with each of the hGAA-anti-hTfR antibody 3N (IgG4) and hGAA at a dosage of 5 mg/kg, the concentration of the hGAA-anti-hTfR antibody 3N (IgG4) and hGAA in the rectus femoris muscle 8 hours after the administration was 0.311 μg/g in terms of a wet weight for the hGAA-anti-hTfR antibody 3N (IgG4) and 0.251 μg/g in terms of a wet weight for hGAA. Namely, the concentration of the hGAA-anti-hTfR antibody 3N (IgG4) was 1.23 times the concentration of hGAA. The same results were obtained when these antibodies were administered at a dosage of 20 mg/kg. Further, the same results were obtained for the extensor digitorum longus muscle, the soleus muscle, the triceps brachii muscle, the major psoas muscle, the diaphragm and the lingual muscle. Namely, it is apparent that the intravenously administered hGAA-anti-hTfR antibody 3N (IgG4) is taken up in skeletal muscle tissues in an amount larger than that of intravenously administered hGAA.

develop a color with a DAB substrate (3,3'-diaminobenzidine, Vector Laboratories Inc.), counterstained with a Mayer's hematoxylin solution (Merck Inc.), dehydrated, cleared, embedded, and observed with a microscope. It is to be noted that immunohistochemical staining was carried out only on the cerebellum of monkeys administered with the hGAA-anti-hTfR antibody 3N (IgG4) at a dosage of 20 mg/kg and administered with hGAA at a dosage of 20 mg/kg. Therefore, the elapsed time after administration is 8 hours for both the antibodies.

Figure 9:
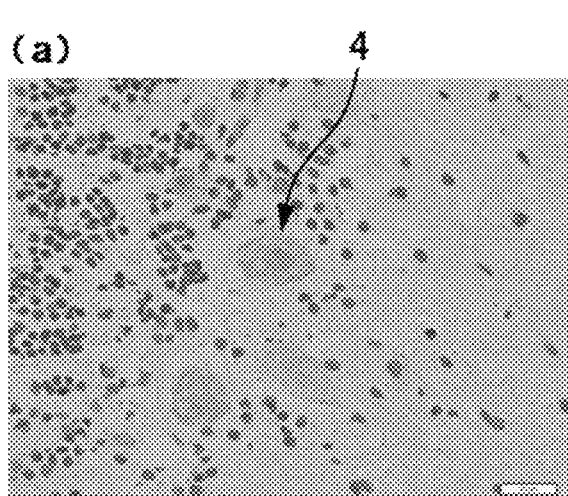
FIG. 9 A figure showing the result of immunohistochemical staining of hGAA in the cerebellum of a crab-eating monkey after a single intravenous administration. (a) hGAA-anti-hTfR antibody 3N (IgG4) administered, (b) hGAA administered. The bar at the bottom right at each photograph is a 20-μm gauge.
Figure 9:
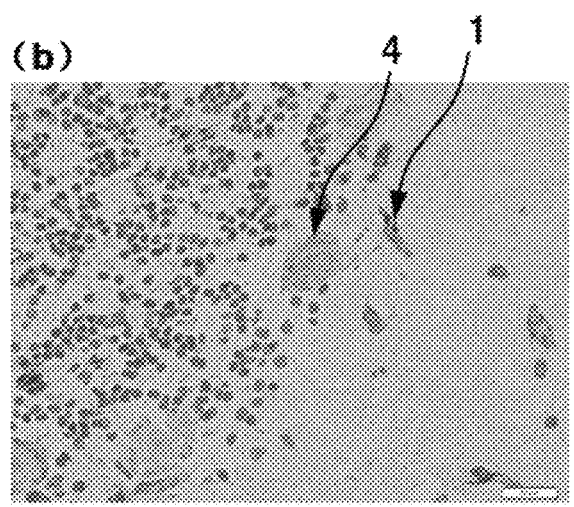

FIG. 9 shows the results of immunohistochemical staining of the hGAA-anti-hTfR antibody 3N (IgG4) and hGAA in the cerebellum. In the cerebellum of the monkey administered with the hGAA-anti-hTfR antibody 3N (IgG4), spe-

TABLE 18

Concentration of hGAA-anti-hTfR antibody 3N (IgG4) in brain tissues and skeletal muscle (μg/g wet weight)

| | | Administered substance | | | | | |
|---|---|---|---|---|---|---|---|
| | | hGAA-anti-hTfR antibody 3N (IgG4) | | | hGAA | | |
| | | Dose | | | | | |
| | | 5 mg/kg | | | 20 mg/kg | 5 mg/kg | 20 mg/kg |
| | | Elapsed time after administration (hr) | | | | | Intrinsic |
| | | 4 | 8 | 24 | 8 | 8 | 8 | GAA |
| Brain | Cerebral cortex | 1.07 | 0.740 | 1.00 | 1.42 | 0.414 | 0.435 | 0.425 |
| | Cerebellum | 0.776 | 0.625 | 0.509 | 1.16 | 0.275 | 0.279 | — |
| | Hippocampus | 1.34 | 0.966 | 1.14 | 1.68 | 0.471 | 0.467 | — |
| | Medulla oblongata | 0.886 | 0.678 | 0.869 | 1.22 | 0.371 | 0.394 | — |
| | Pontine | 0.904 | 0.627 | 0.730 | 1.12 | 0.403 | 0.371 | — |
| Skeletal muscle | Rectus femoris muscle | 0.445 | 0.311 | 0.458 | 0.425 | 0.251 | 0.377 | 0.140 |
| | Extensor digitorum longus muscle | 0.463 | 0.293 | 0.379 | 0.554 | 0.261 | 0.449 | — |
| | Soleus muscle | 0.527 | 0.361 | 0.377 | 0.485 | 0.277 | 0.320 | — |
| | Triceps brachii muscle | 0.315 | 0.311 | 0.250 | 0.482 | 0.231 | 0.314 | — |
| | Major psoas muscle | 0.301 | 0.241 | 0.275 | 0.383 | 0.238 | 0.225 | — |
| | Diaphragm | 0.289 | 0.212 | 0.238 | 0.339 | 0.199 | 0.381 | — |
| | Lingual muscle | 0.882 | 0.631 | 0.794 | 1.10 | 0.316 | 0.915 | — |

Immunohistochemical Staining:

Immunohistochemical staining of the hGAA-anti-hTfR antibody 3N (IgG4) and hGAA in brain tissues was carried out following the procedures described below as a whole. The brain tissues obtained as described above were rapidly frozen to −80° C. in Tissue-Tek Cryo 3DM (Sakura Finetek Inc.), the frozen block thus obtained was sliced into 4-μm sections with LEICA CM 1860 UV Cryostat (Leica Biosystems Nussloch Inc.), and the tissue sections were then applied to MAS-coated glass slides (Matsunami Glass Inc.). The tissue sections were reacted with 4% paraformaldehyde (Wako Pure Chemical Industries Inc.) at 4° C. for 5 minutes, and affixed onto glass slides. Subsequently, the tissue sections were reacted with a methanol solution containing 0.3% hydrogen peroxide (Wako Pure Chemical Industries Inc.) for 30 minutes to inactivate intrinsic peroxidase. The glass slides were then blocked by reacting SuperBlock blocking buffer in PBS at room temperature for 30 minutes. The tissue sections were then reacted with a rabbit anti-hGAA polyclonal antibody as a primary antibody at 4° C. for 16 hours. The tissue sections were then treated with CSAII Rabbit Link (Agilent Inc.) and a CSAII Biotin-free Tyramide Signal Amplification System kit (Agilent Inc.). The tissue sections were then reacted with Anti-Fluorescein HRP at room temperature for 15 minutes. The tissue sections were allowed to cific staining of blood vessels and Purkinje cells was observed (FIG. 9a). On the other hand, in the cerebellum of the monkey administered with hGAA, such staining was not observed (FIG. 9b). These results indicate that by fusing hGAA, which normally does not pass through the blood-brain barrier, with the anti-hTfR antibody 3N (IgG4), the hGGA can be allowed to pass through the blood-brain barrier, and taken up by Purkinje cells in the cerebellum.

Example 29

Assessment of Pharmacological Effect of hGAA-Anti-hTfR Antibody 3N (IgG4) in Mouse: Determination of Concentration of Glycogen (1)

Based on knockout mice as an animal model of Pompe's disease in which an acidic α-glucosidase (GAA) gene is disrupted, mice lacking a GAA gene in homology and having a chimera TfR gene in heterology (GAA-KO/hTfR-KI mice) were prepared by replacing a gene encoding the extracellular region of mouse TfR with a gene encoding the extracellular region of the human TfR receptor gene by the method described in Example 7-2. The mice were divided into seven groups, and the hGAA-anti-hTfR antibody 3N (IgG4) or hGAA was intravenously administered thereto in accordance with the usage and dosage shown in Table 19.

Normal mice which had not been administered with a pharmaceutical agent were categorized as normal controls (first group), and GAA-KO/hTfR-KI mice which had not been administered with a pharmaceutical agent were categorized as disease controls (second group). Each group included five mice. Further, male and female mice which were 9 to 14-week old (at the start of administration) were used.

TABLE 19

Grouping of mice

| Group | Test substance | Mouse | Dosage (mg/kg) | Interval of administration | Number of administrations |
|---|---|---|---|---|---|
| 1 | — | Normal mouse | — | — | — |
| 2 | — | GAA-KO/hTfR-KI mouse | — | — | — |
| 3 | hGAA | GAA-KO/hTfR-KI mouse | 20 | 2 weeks | 4 weeks |
| 4 | hGAA-anti-hTfR antibody 3N (IgG4) | GAA-KO/hTfR-KI mouse | 2.5 | | |
| 5 | | | 5.0 | | |
| 6 | | | 10 | | |
| 7 | | | 20 | | |

At the second and third administration of the test substance, diphenhydramine was administered at a dosage of 10 mL/kg to the mouse 10 to 20 minutes before the administration. This treatment is aimed at preventing occurrence of an immunological reaction such as an anaphylactic shock in experimental animals due to administration of the test substance. 13 days after the last administration, the mouse was decapitated under isoflurane anesthesia, and the right brain and the cervical part of spinal cord were quickly excised, and then quickly immersed in liquid nitrogen to be rapidly frozen. After the freezing, the wet weight of the tissues of each of the organs was measured. For the heart, the diaphragm, the liver, the spleen, the quadriceps femoris muscle, the soleus muscle, the rectus femoris muscle, the extensor digitorum longus muscle and the gastrocnemius muscle (collected skeletal muscle: right leg), blood was sufficiently removed by exsanguination, tissues were then collected, and washed with a physiological saline solution, and the wet weight of the tissues of each of the organs was measured. After the measurement, the organs were each sealed in a 1.5 mL tube, and instantaneously frozen with liquid nitrogen.

Water for injection was added to the tissues of each organ in an amount 20 times the wet weight of the tissues, and the tissues were homogenized using a bead grinder. The homogenized tissues were transferred into a centrifugal tube, heated at 100° C. for 5 minutes, and left standing on ice. Subsequently, the tissues were centrifuged at 13000 rpm at 4° C. for 5 minutes, and the supernatant was collected. The supernatant was frozen and preserved at a temperature of −70° C. or lower.

Figure 10:
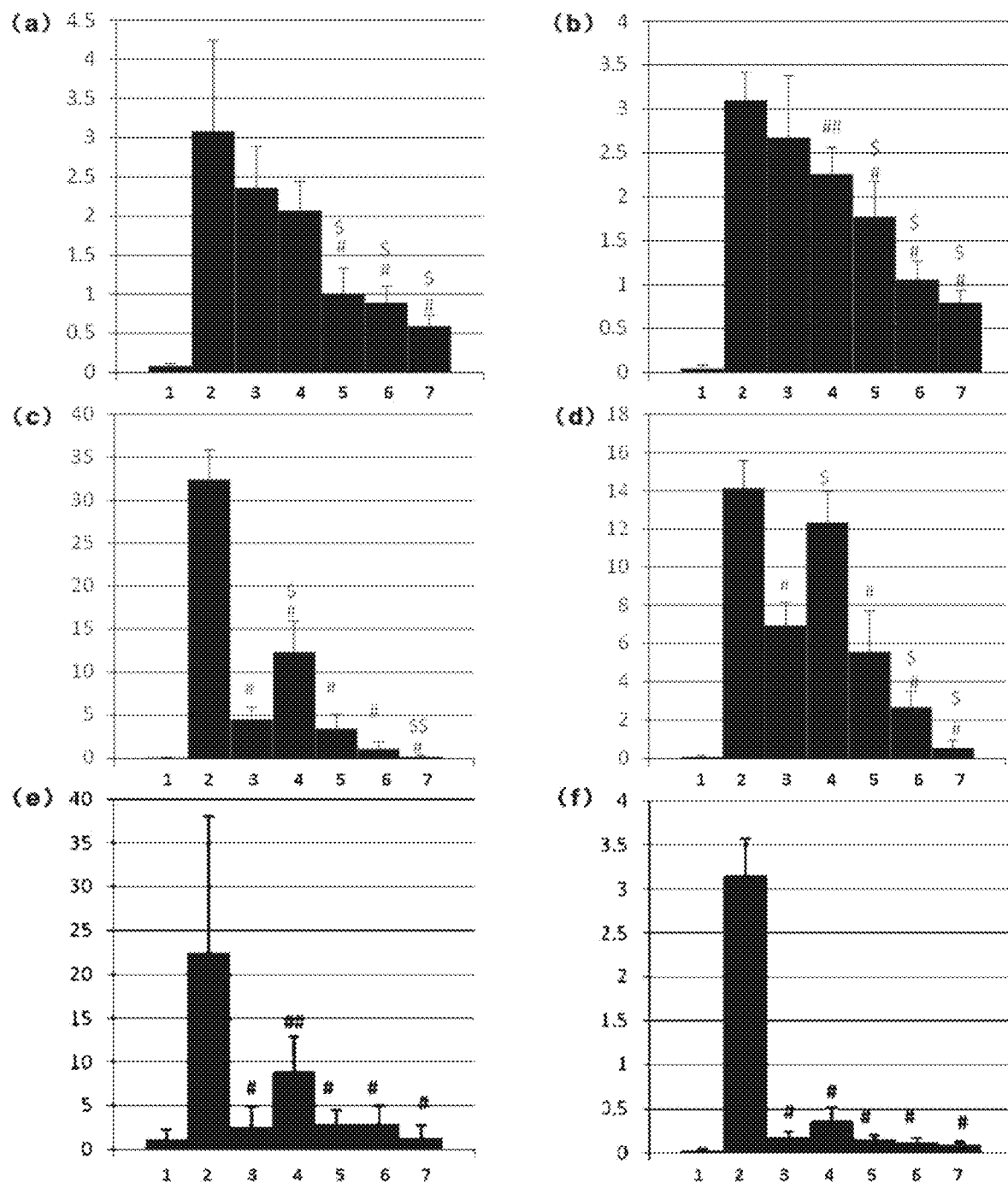
FIG. 10 A figure showing the result of assessment of the pharmacological effect of hGAA-anti-hTfR antibody 3N (IgG4) using a mouse. The concentrations of glycogen in (a) right brain, (b) cervical part of spinal cord, (c) heart, (d) diaphragm, (e) liver and (f) spleen are given. In each figure, numeral 1 indicates a normal control group, numeral 2 indicates a disease control group, numeral 3 indicates a group administered with 20 mg/kg of hGAA, and numerals 4 to 7 indicate groups administered with 2.5 mg/kg, 5.0 mg/kg, 10 mg/kg and 20 mg/kg, respectively, of hGAA-anti-hTfR antibody 3N (IgG4). The ordinate indicates the concentration of glycogen (mg/g in terms of a wet weight). The vertical bar indicates SD, "#" indicates p<0.01 compared with the disease control group, "##" indicates p<0.05 compared with the disease control group, "$" indicates p<0.01 compared with the hGAA administered group, and "$$" indicates p<0.05 compared with the hGAA administered group (each based on Turkey HSD test).
Figure 11:
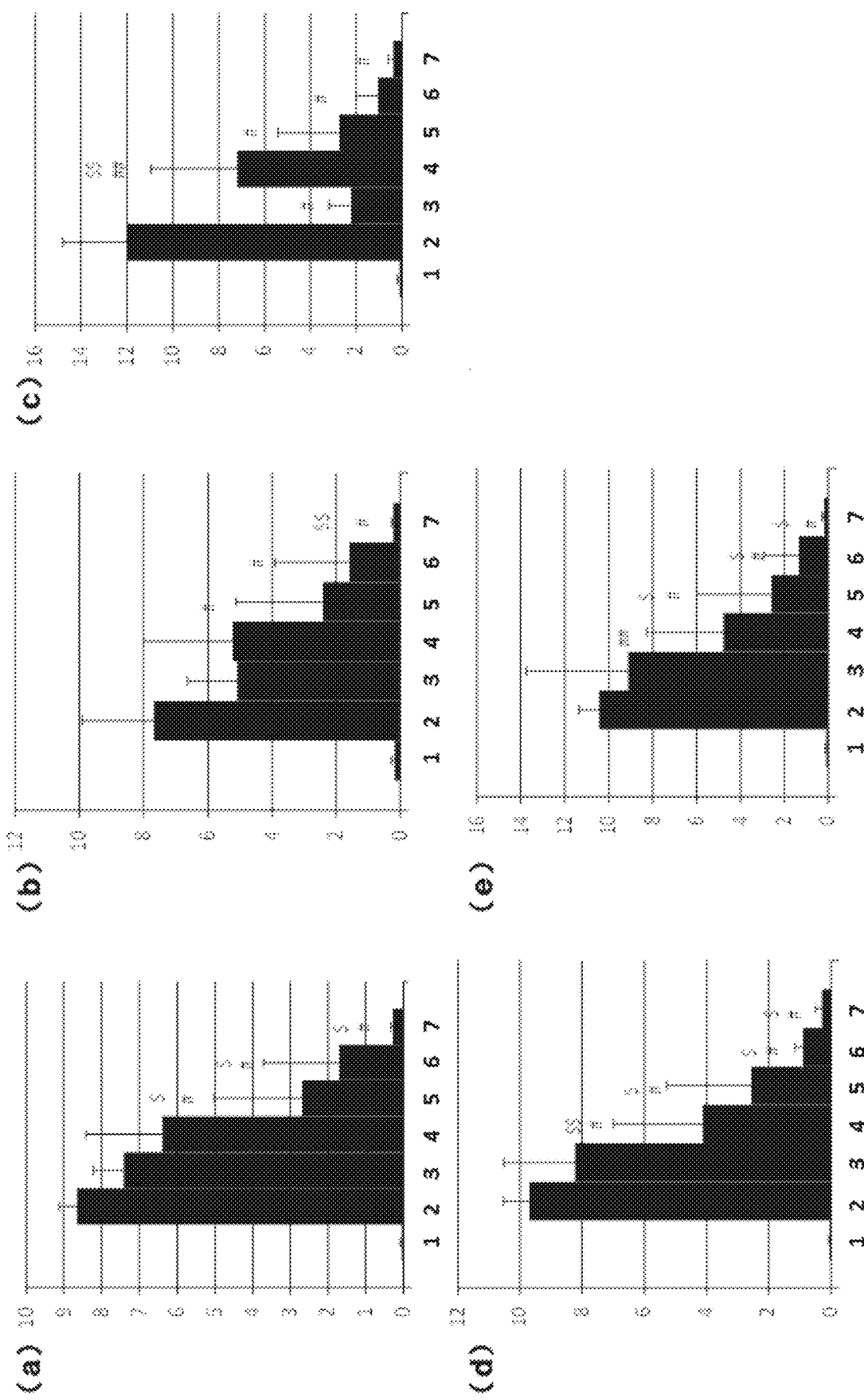
FIG. 11 A figure showing the result of assessment of the pharmacological effect of hGAA-anti-hTfR antibody 3N (IgG4) using a mouse. The concentrations of glycogen in (a) quadriceps femoris muscle, (b) gastrocnemius muscle, (c) soleus muscle, (d) tibialis anterior muscle and (e) extensor digitorum longus muscle gastrocnemius. In each figure, numeral 1 indicates a normal control group, numeral 2 indicates a disease control group, numeral 3 indicates a hGAA administered group, and numerals 4 to 7 indicate groups administered with 2.5 mg/kg, 5.0 mg/kg, 10 mg/kg and 20 mg/kg, respectively, of hGAA-anti-hTfR antibody 3N (IgG4). The ordinate indicates the concentration of glycogen (mg/g in terms of a wet weight). The vertical bar indicates SD, "#" indicates p<0.01 compared with the disease control group, "##" indicates p<0.05 compared with the disease control group, "$" indicates p<0.01 compared with the hGAA administered group, and "$$" indicates p<0.05 compared with the hGAA administered group (each based on Turkey HSD test).

The concentration of glycogen contained in the supernatant was measured by Glycogen Assay Kit (Viovision Inc.). The results of the measurement are shown in FIGS. 10 and 11. FIG. 10 shows the concentrations of glycogen in the right brain, the cervical part of spinal cord, the heart, the diaphragm, the liver and the spleen (FIGS. 10a to 10f, respectively). Further, FIG. 11 shows the concentrations of glycogen in the quadriceps femoris muscle, the soleus muscle, the rectus femoris muscle, the extensor digitorum longus muscle and the gastrocnemius muscle (FIGS. 11a to 11e, respectively). However, the group of mice administered with the hGAA-anti-hTfR antibody 3N (IgG4) at a dosage of 20 mg/kg were excluded because they died 5 days after the last administration.

The results in FIGS. 10 and 11 will be discussed below.

Brain:

The concentrations of glycogen in the brain tissues of the normal control group, the disease control group, the group of mice administered with hGAA at a dosage of 20 mg/kg, and the groups of mice administered with the hGAA-anti-hTfR antibody 3N (IgG4) at dosages of 2.5, 5.0, 10 and 20 mg/kg were 0.0815 mg/g, 3.08 mg/g, 2.36 mg/g, 2.07 mg/g, 1.00 mg/g, 0.891 mg/g and 0.592 mg/g, respectively, in terms of a wet weight (FIG. 10(a)). The groups of mice administered with the hGAA-anti-hTfR antibody 3N (IgG4) at a dosage of not lower than 5.0 mg/kg showed a significant decrease in concentration of glycogen in the tissues as compared to the disease control group and the group of mice administered with hGAA at a dosage of 20 mg/kg. Further, the decrease of the glycogen concentration by the hGAA-anti-hTfR antibody 3N (IgG4) was dosage-dependent.

Cervical Part of Spinal Cord:

The concentrations of glycogen in the cervical cord tissues of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.0459 mg/g, 3.10 mg/g, 2.68 mg/g, 2.26 mg/g, 1.77 mg/g, 1.06 mg/g and 0.795 mg/g, respectively, in terms of a wet weight (FIG. 10(b)). All the groups of mice administered with the hGAA-anti-hTfR antibody 3N (IgG4) showed a significant decrease in concentration of glycogen in the tissues as compared to the disease control group. Further, the groups of mice administered with the hGAA-anti-hTfR antibody 3N (IgG4) at a dosage of not lower than 5.0 mg/kg showed a significant decrease in concentration of glycogen in the tissues as compared to the group of mice administered with hGAA at a dosage of 20 mg/kg. Further, the decrease of the glycogen concentration by the hGAA-anti-hTfR antibody 3N (IgG4) was dosage-dependent.

Heart:

The concentrations of glycogen in the heart of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.0816 mg/g, 32.4 mg/g, 4.54 mg/g, 12.3 mg/g, 3.45 mg/g, 1.10 mg/g and 0.205 mg/g, respectively, in terms of a wet weight (FIG. 10(c)). All the groups of mice administered with the hGAA-anti-hTfR antibody 3N (IgG4) showed a significant decrease in concentration of glycogen in the tissues as compared to the disease control group. The group of mice administered with the hGAA-anti-hTfR antibody 3N (IgG4) at a dosage of 20 mg/kg showed a significant decrease in concentration of glycogen as compared to the group of mice administered with hGAA at a dosage of 20 mg/kg.

Diaphragm:

The concentrations of glycogen in the diaphragm tissues of the normal control group, the disease control group, the group of mice administered with hGAA at a dosage of 20 mg/kg, and the groups of mice administered with the hGAA-anti-hTfR antibody 3N (IgG4) at dosages of 2.5, 5.0, 10 and 20 mg/kg were 0.0824 mg/g, 14.1 mg/g, 6.96 mg/g, 12.4 mg/g, 5.57 mg/g, 2.68 mg/g and 0.564 mg/g, respectively, in terms of a wet weight (FIG. 10(d)). The groups of mice administered with the hGAA-anti-hTfR antibody 3N (IgG4)

at a dosage of not lower than 5.0 mg/kg showed a significant decrease in concentration of glycogen in the tissues as compared to the disease control group. The group of mice administered with the hGAA-anti-hTfR antibody 3N (IgG4) at a dosage of 10 mg/kg showed a significant decrease in concentration of glycogen as compared to the group of mice administered with hGAA at a dosage of 20 mg/kg.

Liver:

The concentrations of glycogen in the liver of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 1.16 mg/g, 22.5 mg/g, 2.65 mg/g, 8.88 mg/g, 2.95 mg/g, 3.01 mg/g and 1.46 mg/g, respectively, in terms of a wet weight (FIG. 10(e)). All the groups of mice administered with the hGAA-anti-HTFR antibody 3N (IgG4), as well as the group of mice administered with hGAA at a dosage of 20 mg/kg, showed a significant decrease in concentration of glycogen in the tissues as compared to the disease control group.

Spleen:

The concentrations of glycogen in the spleen of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.0295 mg/g, 3.15 mg/g, 0.182 mg/g, 0.368 mg/g, 0.165 mg/g, 0.122 mg/g and 0.0990 mg/g, respectively, in terms of a wet weight (FIG. 10(f)). All the groups of mice administered with the hGAA-anti-HTFR antibody 3N (IgG4), as well as the group of mice administered with hGAA at a dosage of 20 mg/kg, showed a significant decrease in concentration of glycogen in the tissues as compared to the disease control group.

Quadriceps Femoris Muscle:

The concentrations of glycogen in the quadriceps femoris muscle tissues of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.0529 mg/g, 8.66 mg/g, 7.41 mg/g, 6.40 mg/g, 2.68 mg/g, 1.71 mg/g and 0.282 mg/g, respectively, in terms of a wet weight (FIG. 11(a)). The groups of mice administered with the hGAA-anti-hTfR antibody 3N (IgG4) at a dosage of not lower than 5.0 mg/kg showed a significant decrease in concentration of glycogen in the tissues as compared to the disease control group and the group of mice administered with hGAA at a dosage of 20 mg/kg. The group of mice administered with hGAA at a dosage of 20 mg/kg did not show a significant decrease in concentration of glycogen in the tissues as compared to the disease control group.

Gastrocnemius Muscle:

The concentrations of glycogen in the gastrocnemius muscle tissues of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.173 mg/g, 7.68 mg/g, 5.09 mg/g, 5.23 mg/g, 2.40 mg/g, 1.58 mg/g and 0.221 mg/g, respectively, in terms of a wet weight (FIG. 11(b)). The groups of mice administered with the hGAA-anti-hTfR antibody 3N (IgG4) at a dosage of not lower than 5.0 mg/kg showed a significant decrease in concentration of glycogen in the tissues as compared to the disease control group. The group of mice administered with hGAA at a dosage of 20 mg/kg did not show a significant decrease in concentration of glycogen in the tissues as compared to the disease control group.

Soleus Muscle:

The concentrations of glycogen in the soleus muscle tissues of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.116 mg/g, 12.08 mg/g, 2.233 mg/g, 7.20 mg/g, 2.74 mg/g, 1.07 mg/g and 0.378 mg/g, respectively, in terms of a wet weight (FIG. 11(c)). All the groups of mice administered with the hGAA-anti-HTFR antibody 3N (IgG4) showed a significant decrease in concentration of glycogen in the tissues as compared to the disease control group. Further, the groups of mice administered with the hGAA-anti-hTfR antibody 3N (IgG4) at a dosage of not lower than 5.0 mg/kg, as well as the group of mice administered with hGAA at a dosage of 20 mg/kg, showed a significant decrease in concentration of glycogen in the tissues.

Rectus Femoris Muscle:

The concentrations of glycogen in the rectus femoris muscle tissues of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.0419 mg/g, 9.68 mg/g, 8.23 mg/g, 4.13 mg/g, 2.56 mg/g, 0.895 mg/g and 0.277 mg/g, respectively, in terms of a wet weight (FIG. 11(d)). All the groups of mice administered with the hGAA-anti-HTFR antibody 3N (IgG4) showed a significant decrease in concentration of glycogen in the tissues as compared to the disease control group and the group of mice administered with hGAA at a dosage of 20 mg/kg. The group of mice administered with hGAA at a dosage of 20 mg/kg did not show a significant decrease in concentration of glycogen in the tissues as compared to the disease control group.

Extensor Digitorum Longus Muscle:

The concentrations of glycogen in the extensor digitorum longus muscle tissues of the normal control group, the disease control group, the group of mice administered with hGAA at a dosage of 20 mg/kg, and the groups of mice administered with the hGAA-anti-HTFR antibody 3N (IgG4) at dosages of 2.5, 5.0, 10 and 20 mg/kg were 0.0950 mg/g, 10.4 mg/g, 9.11 mg/g, 4.79 mg/g, 2.59 mg/g, 1.34 mg/g and 0.188 mg/g, respectively, in terms of a wet weight (FIG. 11(e)). All the groups of mice administered with the hGAA-anti-HTFR antibody 3N (IgG4) showed a significant decrease in concentration of glycogen in the tissues as compared to the disease control group. Further, the groups of mice administered with the hGAA-anti-hTfR antibody 3N (IgG4) at a dosage of not lower than 5.0 mg/kg showed a significant decrease in concentration of glycogen in the tissues as compared to the group of mice administered with hGAA at a dosage of 20 mg/kg. The group of mice administered with hGAA at a dosage of 20 mg/kg did not show a significant decrease in concentration of glycogen in the tissues as compared to the disease control group.

Example 30

Assessment of Pharmacological Effect of hGAA-Anti-hTfR Antibody 3N (IgG4) in Mouse: Histopathological Assessment (2)

The left brain, the cervical part of spinal cord, the quadriceps femoris muscle, the soleus muscle and the extensor digitorum longus muscle, which had been collected in Example 29, was immersed in a sufficient amount of a 10% neutral formalin buffer solution. After about 24 hours, the 10% neutral formalin buffer solution was replaced. 3 days after collection of the tissues, the tissues were immersed in 80% ethanol, and a 48-hour delay timer was programmed, so that the ethanol was replaced with toluene by an automatic fixing and embedding device (Sakura Rotary), the tissues were finally immersed in paraffin, and the samples thus obtained were subjected to PAS staining and HE staining.

The results of PAS staining will be discussed below.

Cerebral Cortex:

As for PAS stainability in cells, all of the disease control group and the group of mice administered with hGAA at a dosage of 20 mg/kg had moderate stainability, whereas the groups of mice administered with the hGAA-anti-hTfR antibody 3N (IgG4) at a dosage of 2.5 to 20 mg/kg showed a decrease in stainability. As for PAS stainability in blood vessels, the group of mice administered with the hGAA-anti-hTfR antibody 3N (IgG4) at a dosage of 20 mg/kg showed a decrease in stainability.

Hippocampus/Dentate Gyrus and Basal Ganglia

The group of mice administered with the hGAA-anti-hTfR antibody 3N (IgG4) at a dosage of 20 mg/kg showed a decrease in PAS stainability in cells and blood vessels as compared to the disease control group. In the basal ganglia, the group of mice administered with the hGAA-anti-hTfR antibody 3N (IgG4) at a dosage of 2.5 mg/kg and the group of mice administered with the hGAA-anti-hTfR antibody 3N (IgG4) at a dosage of 5.0 mg/kg also showed a decrease in stainability.

Interbrain (Thalamus/Hypothalamus):

The groups of mice administered with the hGAA-anti-hTfR antibody 3N (IgG4) at a dosage of 2.5 to 20 mg/kg showed a decrease in PAS stainability as compared to the disease control group.

Midbrain-Pontine:

The groups of mice administered with the hGAA-anti-hTfR antibody 3N (IgG4) at a dosage of 5.0 to 20 mg/kg showed a decrease in PAS stainability.

Medulla Oblongata:

The group of mice administered with the hGAA-anti-hTfR antibody 3N (IgG4) at a dosage of 20 mg/kg showed a decrease in PAS stainability as compared to the disease control group.

Cerebellum:

In the Purkinje cell layer/granulosa layer, the groups of mice administered with the hGAA-anti-hTfR antibody 3N (IgG4) at a dosage of 2.5 to 20 mg/kg tended to show a decrease in PAS stainability in cells on the periphery of Purkinje cells as compared to the disease control group. In the white matter, the groups of mice administered with the hGAA-anti-hTfR antibody 3N (IgG4) at dosages of 2.5 and 20 mg/kg tended to show a decrease in PAS stainability.

Quadriceps Femoris Muscle:

The groups of mice administered with the hGAA-anti-hTfR antibody 3N (IgG4) at dosages of 5.0 and 10 mg/kg tended to show a decrease in PAS stainability as compared to the disease control group, and the group of mice administered with the hGAA-anti-hTfR antibody 3N (IgG4) at a dosage of 20 mg/kg showed a remarkable decrease in stainability.

Soleus Muscle:

The group of mice administered with hGAA at a dosage of 20 mg/kg and the group of mice administered with the hGAA-anti-hTfR antibody 3N (IgG4) at a dosage of 10 mg/kg showed a decrease in PAS stainability as compared to the disease control group, and the group of mice administered with the hGAA-anti-hTfR antibody 3N (IgG4) at a dosage of 20 mg/kg showed a remarkable decrease in stainability.

Next, the results of HE staining will be discussed below.

Cerebral Cortex:

Cerebral cortex: the groups of mice administered with the hGAA-anti-hTfR antibody 3N (IgG4) at a dosage of 5.0 to 20 mg/kg tended to show a reduction in growth of cell tumor as compared to the disease control group. Cerebrum white matter (corpus callosum, fimbria hippocampi and anterior commissure) and brain ventricle: the group of mice administered with hGAA at a dosage of 20 mg/kg and the groups of mice administered with hGAA-anti-hTfR antibody 3N (IgG4) at a dosage of 5.0 to 20 mg/kg showed a decrease in vacuole content of the white matter as compared to the disease control group.

Only the group of mice administered with the hGAA-anti-hTfR antibody 3N (IgG4) at a dosage of 20 mg/kg tended to show a reduction in growth of cell tumor as compared to the medulla oblongata disease control group.

Cerebellum:

The group of mice administered with the hGAA-anti-hTfR antibody 3N (IgG4) at a dosage of 20 mg/kg tended to show a reduction in growth of cell tumor in the white matter.

Quadriceps Femoris Muscle:

The group of mice administered with the hGAA-anti-hTfR antibody 3N (IgG4) at a dosage of 10 mg/kg tended to show a reduction in vacuole/lacuna formation in the muscle fibers as compared to the disease control group, and the group of mice administered with the hGAA-anti-hTfR antibody 3N (IgG4) at a dosage of 20 mg/kg showed a further reduction in vacuole/lacuna formation in the muscle fibers.

Soleus Muscle:

The group of mice administered with hGAA at a dosage of 20 mg/kg and the groups of mice administered with the hGAA-anti-hTfR antibody 3N (IgG4) at a dosage of 5.0 to 10 mg/kg showed a reduction in vacuole/lacuna formation in the muscle fibers as compared to the disease control group, and the group of mice administered with the hGAA-anti-hTfR antibody 3N (IgG4) at a dosage of 20 mg/kg showed little reduction in vacuole/lacuna formation in the muscle fibers.

Extensor Digitorum Longus Muscle:

The group of mice administered with the hGAA-anti-hTfR antibody 3N (IgG4) at a dosage of 5.0 mg/kg showed a reduction in vacuole/lacuna formation in the muscle fibers as compared to the disease control group, and the groups of mice administered with the hGAA-anti-hTfR antibody 3N (IgG4) at a dosage of 10 to 20 mg/kg showed a further reduction in vacuole/lacuna formation in the muscle fibers.

The above results of the pharmacological effect of the hGAA-anti-hTfR antibody 3N (IgG4) in the mouse indicate that administration of the hGAA-anti-hTfR antibody 3N (IgG4) at a dosage of not lower than 5 mg/kg is more effective as a therapeutic agent for Pompe's disease from a histopathological point of view than administration of commercially available hGAA at a dosage of 20 mg/kg, and exhibits an extremely remarkable effect in the central nervous system and the skeletal muscle tissues.

Example 31

Preparation of Fusion Protein Between Fab Anti-hTfR Antibody 3N and hGAA (Fab GS-GAA)

A DNA fragment having a nucleotide sequence set forth as SEQ ID NO: 89 and comprising a gene encoding a fusion protein between hGAA and the Fab heavy chain of a humanized anti-hTfR antibody was artificially synthesized, and inserted into the pE-neo vector between MluI and NotI thereof to construct an expression vector pE-neo (Fab HC-GS-GAA). Here, into the gene encoding the fusion protein, a nucleotide sequence encoding a leader peptide acting as a secretion signal was introduced on the 5'-terminal side of the gene. CHO cells (CHO-K1: purchased from American Type Culture Collection) were transformed with the pE-neo (Fab HC-GS-GAA) and the pE-hygr (LC3) constructed in Example 11 to obtain a cell line expressing a fusion protein between hGAA and an anti-hTfR antibody 3N being Fab (Fab GS-GAA). A culture supernatant was obtained by culturing the expression cell line in accordance with the method described in Example 22. The culture supernatant was loaded on CaptureSelect IgG-CH1 column being a CH1 affinity column (column volume: about 1.0 mL, Thermo Fisher Scientific Inc.), which had been equilibrated with five column volumes of a 20 mM HEPES-NaOH buffer solution (pH: 7.0) containing 100 mM NaCl, to adsorb the fusion protein to the CH1 affinity column. The column was then washed by supplying five column volumes of a 20 mM HEPES-NaOH buffer solution (pH: 7.0) containing 100 mM NaCl. The fusion protein adsorbed to the CH1 affinity column was then eluted with five column volumes of a 100 mM glycine buffer solution (pH: 3.0) containing 50 mM NaCl. The eluate was immediately neutralized by adding the eluate in a container which had been supplied with a 1 M HEPES-NaOH buffer solution (pH: 7.5) in advance. The product thus obtained was used as a purification product of Fab GS-GAA in the following experiments.

Example 32

Assessment of Pharmacological Effect of Fab GS-GAA in Mouse

Figure 12:
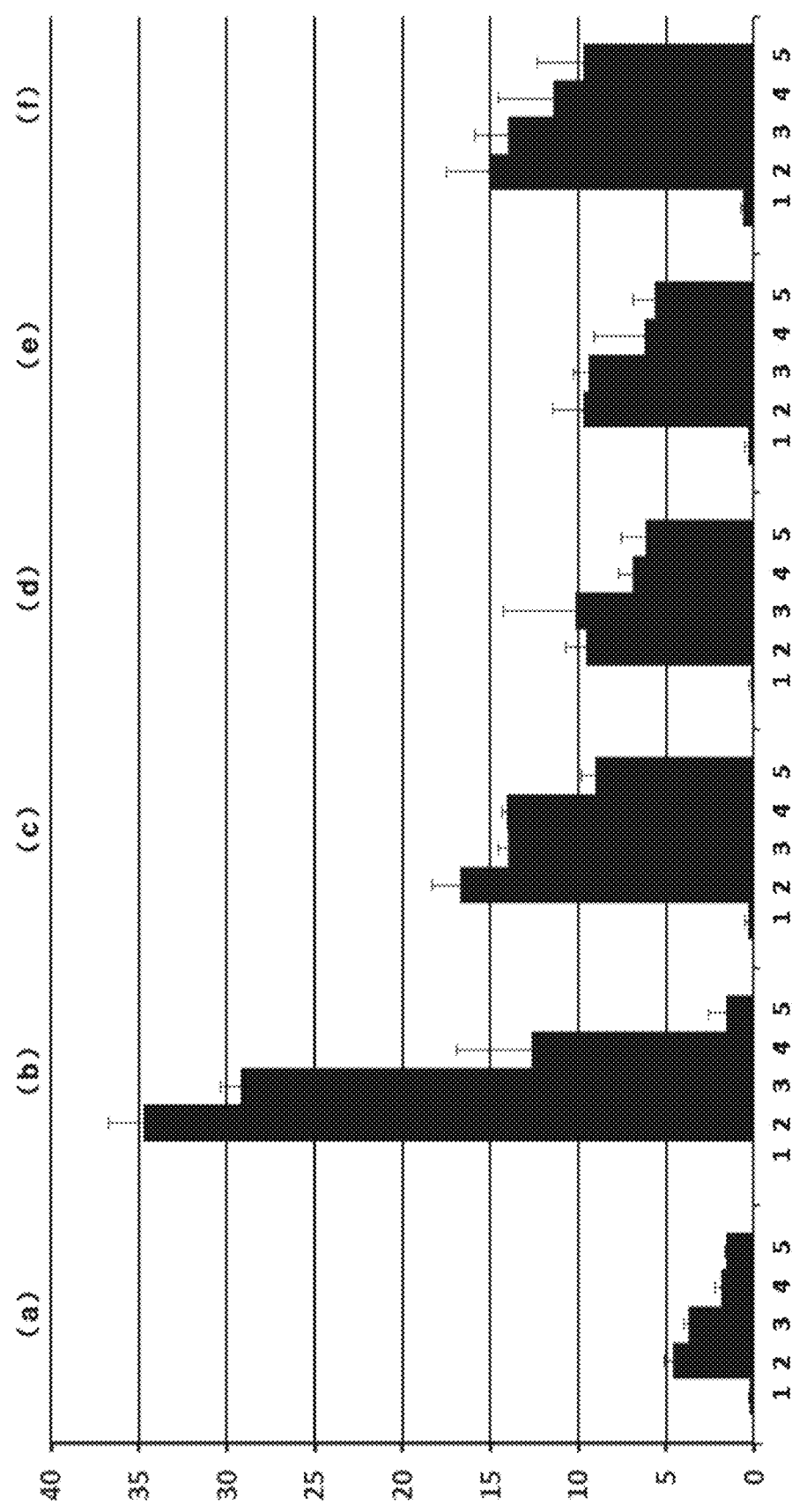
FIG. 12 A figure showing the result of assessment of the pharmacological effect of Fab GS-GAA using a mouse. The concentrations of glycogen in (a) right brain, (b) heart, (c) diaphragm, (d) quadriceps femoris muscle, (e) soleus muscle and (f) tibialis anterior muscle. In each figure, numeral 1 indicates a normal control group, numeral 2 indicates a disease control group, numeral 3 indicates a hGAA administered group, and numerals 4 and 5 indicate 5.0 mg/kg and 20 mg/kg, respectively, of Fab GS-GAA. The ordinate indicates the concentration of glycogen (mg/g in terms of a wet weight). The vertical bar indicates SD.

To the mice (GAA-KO/hTfR-KI mice) described in Example 28, the Fab GS-GAA obtained in Example 31, or hGAA was intravenously administered in accordance with the usage and dosage described in Table 19-2. Normal mice which had not been administered with a pharmaceutical agent were categorized as normal controls (first group), and GAA-KO/hTfR-KI mice which had not been administered with a pharmaceutical agent were categorized as disease controls (second group). Each group included three or four mice. Further, male and female mice which were 9 to 14-week old (at the start of administration) were used. One week after the administration, the right brain, the heart, the diaphragm, the quadriceps femoris muscle, the soleus muscle and the rectus femoris muscle were collected by the method described in Example 29, the concentration of glycogen contained in the tissues of each of the organs was measured. The results of the measurement are shown in FIG. 12. As compared to the group of mice administered with hGAA, the group of mice administered with Fab GS-GAA showed a remarkable decrease in concentration of glycogen in all the organs whose glycogen concentration was measured. The group of mice administered with Fab GS-GAA showed a particularly remarkable decrease in concentration of glycogen in the right brain and the heart. Further, the group of mice administered with Fab GS-GAA at a dosage of 5.0 mg/kg showed a remarkable decrease in concentration of glycogen in the right brain and the heart as compared to the group of mice administered with hGAA at a dosage of 20 mg/kg. These results indicate that Fab GS-GAA can be used as a therapeutic agent for Pompe's disease, particularly as a therapeutic agent for Pompe's disease accompanied by brain and/or heart dysfunction.

TABLE 19-2

Grouping of mice

| Group | Test substance | Mouse | Dosage (mg/kg) |
| --- | --- | --- | --- |
| 1 | — | Normal mouse | — |
| 2 | — | GAA-KO/hTfR-KI mouse | — |
| 3 | hGAA | GAA-KO/hTfR-KI mouse | 20 |
| 4 | Fab GS-GAA | GAA-KO/hTfR-KI mouse | 5.0 |
| 5 | | | 20 |

Example 33

Preparation of Fusion Proteins Between Various Human Lysosomal Enzymes and Humanized Anti-hTfR Antibody A DNA fragment was artificially synthesized which had a nucleotide sequence comprising a gene encoding fusion proteins between various human lysosomal enzymes and the heavy chain of a humanized anti-hTfR antibody (note: the expression vector was a single-chain humanized anti-hTfR antibody when the fusion protein was scFab-IDUA). These fusion proteins have amino acid sequences set forth as SEQ ID NONS shown in Tables 20-A to 20-C, and are designated in the column of "fusion protein designation" in Tables 20-A to 20-C. The synthesized DNA fragment was inserted into the pE-neo vector between MluI and NotI thereof to construct an expression vector. Here, into the gene encoding the fusion protein, a nucleotide sequence encoding a leader peptide acting as a secretion signal was introduced on the 5'-terminal side of the gene. The designations of the expression vectors are shown in Tables 20-A to 20-C. CHO cells (CHO-K1: purchased from American Type Culture Collection) were transformed with each expression vector obtained and the pE-hygr (LC3) constructed in Example 11 to obtain a cell line expressing fusion proteins between various lysosomal enzymes and a humanized anti-hTfR antibody. A culture supernatant was obtained by culturing the expression cell line in accordance with the method described in Example 22.

The fusion proteins between the lysosomal enzyme and the humanized anti-hTfR antibody, which were contained in the culture supernatant, were produced by the following purification method 1 for those having Fab as an antibody, and by the following purification method 2 for those with an antibody including the full length of the heavy chain.

Purification method 1: The culture supernatant was loaded on CaptureSelect IgG-CH1 column being a CH1 affinity column (column volume: about 1.0 mL, Thermo Fisher Scientific Inc.), which had been equilibrated with five column volumes of a 20 mM HEPES-NaOH buffer solution (pH: 7.0) containing 100 mM NaCl, to adsorb the fusion protein to the CH1 affinity column. The column was then washed by supplying five column volumes of a 20 mM HEPES-NaOH buffer solution (pH: 7.0) containing 100 mM NaCl. The fusion protein adsorbed to the CH1 affinity column was then eluted with five column volumes of a 100 mM glycine buffer solution (pH: 3.0) containing 50 mM NaCl. The eluate was immediately neutralized by adding the eluate in a container which had been supplied with a 1 M HEPES-NaOH buffer solution (pH: 7.5) in advance.

Purification method 2: The culture supernatant was loaded on MabSelect SuRe LX column being a protein A affinity column (column volume: about 1.0 mL, GE Healthcare Inc.), which had been equilibrated with five column volumes of a 20 mM HEPES-NaOH buffer solution (pH: 7.0) containing 100 mM NaCl, to adsorb the fusion protein to the protein A. The column was then washed by supplying five column volumes of a 20 mM HEPES-NaOH buffer solution (pH: 7.0) containing 100 mM NaCl. The fusion protein adsorbed to the protein A was then eluted with five column volumes of a 100 mM glycine buffer solution (pH: 3.0) containing 50 mM NaCl. The eluate was immediately neutralized by adding the eluate in a container which had been supplied with a 1 M HEPES-NaOH buffer solution (pH: 7.5) in advance.

Using the thus-obtained purification products of fusion proteins, the following experiments were conducted. Further, the thus-obtained fusion proteins between lysosomal enzymes and a humanized anti-hTfR antibody were designated as shown in the rightmost column in Tables 20-A to 20-C.

TABLE 20(A)

List of fusion proteins between various human lysosomal enzymes and humanized anti-hTfR antibody

| Designation of lysosome | SEQ ID NO | Designation of fusion protein | Designation of expression vector | Light-chain expression vector | Designation of lysosomal enzyme-humanized anti-hTfR antibody fusion protein |
|---|---|---|---|---|---|
| hGAA | 89 | Fab HC-GS3-GAA | pE-neo (Fab HC-GS3-GAA) | pE-hygr (LC3) | Fab GS3-GAA |
| hIDUA | 90 | IgG4 HC-IDUA | pE-neo (IgG4 HC-IDUA) | pE-hygr (LC3) | IgG4 IDUA |
|  | 91 | IgG4 HC-GS8-IDUA | pE-neo (IgG4 HC-GS8-IDUA) | pE-hygr (LC3) | IgG4 GS8-IDUA |
|  | 92 | IgG4 HC-GS20-IDUA | pE-neo (IgG4 HC-GS20-IDUA) | pE-hygr (LC3) | IgG4 GS20-IDUA |
|  | 93 | Fab HC-GS3-IDUA | pE-neo (Fab HC-GS3-IDUA) | pE-hygr (LC3) | Fab GS3-IDUA |
|  | 94 | Fab HC-GS5-IDUA | pE-neo (Fab HC-GS5-IDUA) | pE-hygr (LC3) | Fab GS5-IDUA |
|  | 95 | Fab HC-GS10-IDUA | pE-neo (Fab HC-GS10-IDUA) | pE-hygr (LC3) | Fab GS10-IDUA |
|  | 96 | Fab HC-GS20-IDUA | pE-neo (Fab HC-GS20-IDUA) | pE-hygr (LC3) | Fab GS20-IDUA |
|  | 97 | Tandem Fab HC-IDUA | pE-neo (Tandem Fab HC-IDUA) | pE-hygr (LC3) | Tandem Fab IDUA |
|  | 99 | scFab-IDUA | pE-neo (scFab-IDUA) | — | scFab-IDUA |
| hPPT-1 | 100 | IgG4 HC-PPT1 | pE-neo (IgG4 HC-PPT1) | pE-hygr (LC3) | IgG4 PPT1 |
|  | 101 | IgG4 HC-GS5-PPT1 | pE-neo (IgG4 HC-GS5-PPT1) | pE-hygr (LC3) | IgG4 GS5-PPT1 |
|  | 102 | IgG4 HC-GS10-PPT1 | pE-neo (IgG4 HC-GS10-PPT1) | pE-hygr (LC3) | IgG4 GS10-PPT1 |
|  | 103 | IgG4 HC-GS20-PPT1 | pE-neo (IgG4 HC-GS20-PPT1) | pE-hygr (LC3) | IgG4 GS20-PPT1 |
|  | 104 | Fab HC-GS3-PPT1 | pE-neo (Fab HC-GS3-PPT1) | pE-hygr (LC3) | Fab GS3-PPT1 |
|  | 105 | Tandem Fab HC-PPT1 | pE-neo (Tandem Fab HC-PPT1) | pE-hygr (LC3) | Tandem Fab PPT1 |
| hASM | 106 | IgG4 HC-ASM | pE-neo (IgG4 HC-ASM) | pE-hygr (LC3) | IgG4 ASM |
|  | 107 | IgG4 HC-GS5-ASM | pE-neo (IgG4 HC-GS5-ASM) | pE-hygr (LC3) | IgG4 GS5-ASM |
|  | 108 | IgG4 HC-GS10-ASM | pE-neo (IgG4 HC-GS10-ASM) | pE-hygr (LC3) | IgG4 GS10-ASM |
|  | 109 | IgG4 HC-GS20-ASM | pE-neo (IgG4 HC-GS20-ASM) | pE-hygr (LC3) | IgG4 GS20-ASM |
|  | 110 | Fab HC-GS3-ASM | pE-neo (Fab HC-GS3-ASM) | pE-hygr (LC3) | Fab GS3-ASM |
|  | 111 | Fab HC-GS5-ASM | pE-neo (Fab HC-GS5-ASM) | pE-hygr (LC3) | Fab GS5-ASM |
|  | 112 | Fab HC-GS10-ASM | pE-neo (Fab HC-GS10-ASM) | pE-hygr (LC3) | Fab GS10-ASM |
|  | 113 | Fab HC-GS20-ASM | pE-neo (Fab HC-GS20-ASM) | pE-hygr (LC3) | Fab GS20-ASM |
|  | 114 | Tandem Fab HC-ASM | pE-neo (Tandem Fab HC-ASM) | pE-hygr (LC3) | Tandem Fab ASM |
| hARSA | 115 | IgG4 HC-ARSA | pE-neo (IgG4 HC-ARSA) | pE-hygr (LC3) | IgG4 ARSA |
|  | 116 | IgG4 HC-GS5-ARSA | pE-neo (IgG4 HC-GS5-ARSA) | pE-hygr (LC3) | IgG4 GS5-ARSA |
|  | 117 | IgG4 HC-GS10-ARSA | pE-neo (IgG4 HC-GS10-ARSA) | pE-hygr (LC3) | IgG4 GS10-ARSA |
|  | 118 | IgG4 HC-GS20-ARSA | pE-neo (IgG4 HC-GS20-ARSA) | pE-hygr (LC3) | IgG4 GS20-ARSA |
|  | 119 | Fab HC-GS3-ARSA | pE-neo (Fab HC-GS3-ARSA) | pE-hygr (LC3) | Fab GS3-ARSA |
|  | 120 | Fab HC-GS5-ARSA | pE-neo (Fab HC-GS5-ARSA) | pE-hygr (LC3) | Fab GS5-ARSA |
|  | 121 | Fab HC-GS10-ARSA | pE-neo (Fab HC-GS10-ARSA) | pE-hygr (LC3) | Fab GS10-ARSA |
|  | 122 | Fab HC-GS20-ARSA | pE-neo (Fab HC-GS20-ARSA) | pE-hygr (LC3) | Fab GS20-ARSA |
|  | 123 | Tandem Fab HC-ARSA | pE-neo (Tandem Fab HC-ARSA) | pE-hygr (LC3) | Tandem Fab ARSA |

TABLE 20(B)

List of fusion proteins between various human lysosomal enzymes and humanized anti-hTfR antibody

| Designation of lysosome | SEQ ID NO | Designation of fusion protein | Designation of expression vector | Light-chain expression vector | Designation of lysosomal enzyme-humanized anti-hTfR antibody fusion protein |
|---|---|---|---|---|---|
| hSGSH | 124 | IgG4 HC-SGSH | pE-neo (IgG4 HC-SGSH) | pE-hygr (LC3) | IgG4 SGSH |
|  | 125 | IgG4 HC-GS5-SGSH | pE-neo (IgG4 HC-GS5-SGSH) | pE-hygr (LC3) | IgG4 GS5-SGSH |
|  | 126 | IgG4 HC-GS10-SGSH | pE-neo (IgG4 HC-GS10-SGSH) | pE-hygr (LC3) | IgG4 GS10-SGSH |
|  | 127 | IgG4 HC-GS20-SGSH | pE-neo (IgG4 HC-GS20-SGSH) | pE-hygr (LC3) | IgG4 GS20-SGSH |
|  | 128 | Fab HC-GS3-SGSH | pE-neo (Fab HC-GS3-SGSH) | pE-hygr (LC3) | Fab GS3-SGSH |
|  | 129 | Tandem Fab HC-SGSH | pE-neo (Tandem Fab HC-SGSH) | pE-hygr (LC3) | TandemFab SGSH |
| hGBA | 130 | IgG4 HC-GBA | pE-neo (IgG4 HC-GBA) | pE-hygr (LC3) | IgG4 GBA |
|  | 131 | IgG4 HC-GS5-GBA | pE-neo (IgG4 HC-GS5-GBA) | pE-hygr (LC3) | IgG4 GS5-GBA |
|  | 132 | IgG4 HC-GS10-GBA | pE-neo (IgG4 HC-GS10-GBA) | pE-hygr (LC3) | IgG4 GS10-GBA |
|  | 133 | IgG4 HC-GS20-GBA | pE-neo (IgG4 HC-GS20-GBA) | pE-hygr (LC3) | IgG4 GS20-GBA |

TABLE 20(B)-continued

List of fusion proteins between various human lysosomal enzymes and humanized anti-hTfR antibody

| Designation of lysosome | SEQ ID NO | Designation of fusion protein | Designation of expression vector | Light-chain expression vector | Designation of lysosomal enzyme-humanized anti-hTfR antibody fusion protein |
|---|---|---|---|---|---|
| | 134 | Fab HC-GS3-GBA | pE-neo (Fab HC-GS3-GBA) | pE-hygr (LC3) | Fab GS3-GBA |
| | 135 | Tandem Fab HC-GBA | pE-neo (Tandem Fab HC-GBA) | pE-hygr (LC3) | TandemFab GBA |
| hTPP-1 | 136 | IgG4 HC-TPP1 | pE-neo (IgG4 HC-TPP1) | pE-hygr (LC3) | IgG4 TPP1 |
| | 137 | IgG4 HC-GS5-TPP1 | pE-neo (IgG4 HC-GS5-TPP1) | pE-hygr (LC3) | IgG4 GS5-TPP1 |
| | 138 | IgG4 HC-GS10-TPP1 | pE-neo (IgG4 HC-GS10-TPP1) | pE-hygr (LC3) | IgG4 GS10-TPP1 |
| | 139 | IgG4 HC-GS20-TPP1 | pE-neo (IgG4 HC-GS20-TPP1) | pE-hygr (LC3) | IgG4 GS20-TPP1 |
| | 140 | Fab HC-GS3-TPP1 | pE-neo (Fab HC-GS3-TPP1) | pE-hygr (LC3) | Fab GS3-TPP1 |
| | 141 | Tandem Fab HC-TPP1 | pE-neo (TandemFab HC-TPP1) | pE-hygr (LC3) | Tandem Fab TPP1 |
| hNAGLU | 142 | IgG4 HC-NAGLU | pE-neo (IgG4 HC-NAGLU) | pE-hygr (LC3) | IgG4 NAGLU |
| | 143 | IgG4 HC-GS5-NAGLU | pE-neo (IgG4 HC-GS5-NAGLU) | pE-hygr (LC3) | IgG4 GS5-NAGLU |
| | 144 | IgG4 HC-GS10-NAGLU | pE-neo (IgG4 HC-GS10-NAGLU) | pE-hygr (LC3) | IgG4 GS10-NAGLU |
| | 145 | IgG4 HC-GS20-NAGLU | pE-neo (IgG4 HC-GS20-NAGLU) | pE-hygr (LC3) | IgG4 GS20-NAGLU |
| | 146 | Fab HC-GS3-NAGLU | pE-neo (Fab HC-GS3-NAGLU) | pE-hygr (LC3) | Fab GS3-NAGLU |
| | 147 | Fab HC-GS5-NAGLU | pE-neo (Fab HC-GS5-NAGLU) | pE-hygr (LC3) | Fab GS5-NAGLU |
| | 148 | Fab HC-GS10-NAGLU | pE-neo (Fab HC-GS10-NAGLU) | pE-hygr (LC3) | Fab GS10-NAGLU |
| | 149 | Fab HC-GS20-NAGLU | pE-neo (Fab HC-GS20-NAGLU) | pE-hygr (LC3) | Fab GS20-NAGLU |
| hGUSB | 150 | IgG4 HC-GUSB | pE-neo (IgG4 HC-GUSB) | pE-hygr (LC3) | IgG4 GUSB |
| | 151 | IgG4 HC-GS5-GUSB | pE-neo (IgG4 HC-GS5-GUSB) | pE-hygr (LC3) | IgG4 GS5-GUSB |
| | 152 | IgG4 HC-GS10-GUSB | pE-neo (IgG4 HC-GS10-GUSB) | pE-hygr (LC3) | IgG4 GS10-GUSB |
| | 153 | IgG4 HC-GS20-GUSB | pE-neo (IgG4 HC-GS20-GUSB) | pE-hygr (LC3) | IgG4 GS20-GUSB |
| | 154 | Fab HC-GS3-GUSB | pE-neo (Fab HC-GS3-GUSB) | pE-hygr (LC3) | Fab GS3-GUSB |
| | 155 | Fab HC-GS5-GUSB | pE-neo (Fab HC-GS5-GUSB) | pE-hygr (LC3) | Fab GS5-GUSB |
| | 156 | Fab HC-GS10-GUSB | pE-neo (Fab HC-GS10-GUSB) | pE-hygr (LC3) | Fab GS10-GUSB |
| | 157 | Fab HC-GS20-GUSB | pE-neo (Fab HC-GS20-GUSB) | pE-hygr (LC3) | Fab GS20-GUSB |

TABLE 20(C)

List of fusion proteins between various human lysosomal enzymes and humanized anti-hTfR antibody

| Designation of lysosome | SEQ ID NO | Designation of fusion protein | Designation of expression vector | Light-chain expression vector | Designation of lysosomal enzyme-humanized anti-hTfR antibody fusion protein |
|---|---|---|---|---|---|
| hGALC | 158 | IgG4 HC-GALC | pE-neo (IgG4 HC-GALC) | pE-hygr (LC3) | IgG4 GALC |
| | 159 | IgG4 HC-GS5-GALC | pE-neo (IgG4 HC-GS5-GALC) | pE-hygr (LC3) | IgG4 GS5-GALC |
| | 160 | IgG4 HC-GS10-GALC | pE-neo (IgG4 HC-GS10-GALC) | pE-hygr (LC3) | IgG4 GS10-GALC |
| | 161 | IgG4 HC-GS20-GALC | pE-neo (IgG4 HC-GS20-GALC) | pE-hygr (LC3) | IgG4 GS20-GALC |
| | 162 | Fab HC-GS3-GALC | pE-neo (Fab HC-GS3-GALC) | pE-hygr (LC3) | Fab GS3-GALC |
| | 163 | Fab HC-GS5-GALC | pE-neo (Fab HC-GS5-GALC) | pE-hygr (LC3) | Fab GS5-GALC |
| | 164 | Fab HC-GS10-GALC | pE-neo (Fab HC-GS10-GALC) | pE-hygr (LC3) | Fab GS10-GALC |
| | 165 | Fab HC-GS20-GALC | pE-neo (Fab HC-GS20-GALC) | pE-hygr (LC3) | Fab GS20-GALC |
| hAC | 166 | IgG4 HC-AC | pE-neo (IgG4 HC-AC) | pE-hygr (LC3) | IgG4 AC |
| | 167 | IgG4 HC-GS5-AC | pE-neo (IgG4 HC-GS5-AC) | pE-hygr (LC3) | IgG4 GS5-AC |
| | 168 | IgG4 HC-GS10-AC | pE-neo (IgG4 HC-GS10-AC) | pE-hygr (LC3) | IgG4 GS10-AC |
| | 169 | IgG4 HC-GS20-AC | pE-neo (IgG4 HC-GS20-AC) | pE-hygr (LC3) | IgG4 GS20-AC |
| | 170 | Fab HC-GS3-AC | pE-neo (Fab HC-GS3-AC) | pE-hygr (LC3) | Fab GS3-AC |
| | 171 | Fab HC-GS5-AC | pE-neo (Fab HC-GS5-AC) | pE-hygr (LC3) | Fab GS5-AC |
| | 172 | Fab HC-GS10-AC | pE-neo (Fab HC-GS10-AC) | pE-hygr (LC3) | Fab GS10-AC |
| | 173 | Fab HC-GS20-AC | pE-neo (Fab HC-GS20-AC) | pE-hygr (LC3) | Fab GS20-AC |
| hFUCA1 | 174 | IgG4 HC-FUCA1 | pE-neo (IgG4 HC-FUCA1) | pE-hygr (LC3) | IgG4 FUCA1 |
| | 175 | IgG4 HC-GS5-FUCA1 | pE-neo (IgG4 HC-GS5-FUCA1) | pE-hygr (LC3) | IgG4 GS5-FUCA1 |
| | 176 | IgG4 HC-GS10-FUCA1 | pE-neo (IgG4 HC-GS10-FUCA1) | pE-hygr (LC3) | IgG4 GS10-FUCA1 |
| | 177 | IgG4 HC-GS20-FUCA1 | pE-neo (IgG4 HC-GS20-FUCA1) | pE-hygr (LC3) | IgG4 GS20-FUCA1 |
| | 178 | Fab HC-GS3-FUCA1 | pE-neo (Fab HC-GS3-FUCA1) | pE-hygr (LC3) | Fab GS3-FUCA1 |
| | 179 | Fab HC-GS5-FUCA1 | pE-neo (Fab HC-GS5-FUCA1) | pE-hygr (LC3) | Fab GS5-FUCA1 |
| | 180 | Fab HC-GS10-FUCA1 | pE-neo (Fab HC-GS10-FUCA1) | pE-hygr (LC3) | Fab GS10-FUCA1 |
| | 181 | Fab HC-GS20-FUCA1 | pE-neo (Fab HC-GS20-FUCA1) | pE-hygr (LC3) | Fab GS20-FUCA1 |
| hLAMAN | 182 | IgG4 HC-LAMAN | pE-neo (IgG4 HC-LAMAN) | pE-hygr (LC3) | IgG4 LAMAN |
| | 183 | IgG4 HC-GS5-LAMAN | pE-neo (IgG4 HC-GS5-LAMAN) | pE-hygr (LC3) | IgG4 GS5-LAMAN |
| | 184 | IgG4 HC-GS10-LAMAN | pE-neo (IgG4 HC-GS10-LAMAN) | pE-hygr (LC3) | IgG4 GS10-LAMAN |
| | 185 | IgG4 HC-GS20-LAMAN | pE-neo (IgG4 HC-GS20-LAMAN) | pE-hygr (LC3) | IgG4 GS20-LAMAN |
| | 186 | Fab HC-GS3-LAMAN | pE-neo (Fab HC-GS3-LAMAN) | pE-hygr (LC3) | Fab GS3-LAMAN |
| | 187 | Fab HC-GS5-LAMAN | pE-neo (Fab HC-GS5-LAMAN) | pE-hygr (LC3) | Fab GS5-LAMAN |
| | 188 | Fab HC-GS10-LAMAN | pE-neo (Fab HC-GS10-LAMAN) | pE-hygr (LC3) | Fab GS10-LAMAN |
| | 189 | Fab HC-GS20-LAMAN | pE-neo (Fab HC-GS20-LAMAN) | pE-hygr (LC3) | Fab GS20-LAMAN |

Example 34

Measurement of Affinity of Fusion Proteins Between Various Human Lysosomal Enzymes and Humanized Anti-hTfR Antibody to Human TfR and Monkey TfR, and Enzymatic Activity of the Fusion Proteins The affinity to human TfR and monkey TfR was measured by the method described in Example 7. The activity of the human lysosomal enzyme was measured by the method described below. However, the enzymatic activity of hAC and hLAMAN was not measured.

Measurement of Activity of hIDUA

The purified anti-TfR antibody fusion protein of hIDUA was diluted to an appropriate concentration with a 50 mM citrate buffer solution (pH: 3.5) containing 0.1% BSA, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-Methylumbelliferyl α-L-Iduronide (glycosynth Inc.) was diluted to 1 mM with the above-described buffer solution, and 60 μL of the resulting dilution was added to each well. The mixture was stirred by a plate mixer, and then reacted at 37° C. for 1 hour. After the reaction, 200 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined in terms of a specific activity per protein unit weight (mg) with one unit defined as 4 MU μmol/minute at 37° C. For the following fusion proteins, the specific activity was determined as well.

Measurement of Activity of hPPT-1:

β-Glucosidase (Oriental Yeast Co., Ltd.) was diluted to 0.25 mg/mL with a 0.4 M $Na_2HPO_4$/0.2 M citrate buffer solution (pH: 4.0) containing 0.2% BSA and 0.00625% Triton X-100, and 20 μL of the resulting dilution was added to each well of FluoroNunc Plate F96 (Nunc Inc.). Next, the purified anti-TfR antibody fusion protein of hPPT-1 was diluted to an appropriate concentration with the above-described buffer solution, and 20 μL of the resulting dilution was added to each well. 4-Methylumbelliferone (4MU) (Sigma Inc.) was used as a standard. Next, as a substrate, 4-Methylumbelliferyl 6-Thio-palmitate-β-D-glucopyranoside (Santa Cruz Biotechnology Inc.) was diluted to 0.25 mM with the above-described buffer solution, and 20 μL of the resulting dilution was added to each well. The mixture was stirred by a plate mixer, and then reacted at 37° C. for 1 hour. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hASM:

The purified anti-TfR antibody fusion protein of hASM was diluted to an appropriate concentration with a 250 mM acetate buffer solution (pH: 5.0) containing 0.1 mM zinc acetate, 0.25 mg/mL BSA and 0.15% Tween 20, and 20 μL of the resulting dilution was added to each well of Fluoro-Nunc Plate F96 (Nunc Inc.). 4-Methylumbelliferone (4MU) (Sigma Inc.) was used as a standard. Next, as a substrate, 6-Hexadecanoylamino-4-methylumbelliferyl phosphorylcholine (Carbosynth Inc.) was diluted to 1 mM with the above-described buffer solution, and 20 μL of the resulting dilution was added to each well. The mixture was stirred by a plate mixer, and then reacted at 37° C. for 1 hour. After the reaction, 200 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined in terms of a specific activity per protein unit weight (mg) with one unit defined as 4 MU μmol/minute at 37° C.

Measurement of Activity of hARSA:

The purified anti-TfR antibody fusion protein of hARSA was diluted to an appropriate concentration with a 50 mM acetate buffer solution (pH: 5.0) containing 0.5% BSA and 1.0% Triton-X 100, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-methylumbelliferyl sulfate potassium salt (Sigma Inc.) was diluted to 5 mM with the above-described buffer solution, and 100 μL of the resulting dilution was added to each well. The mixture was stirred by a plate mixer, and then reacted at 37° C. for 1 hour. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hSGSH:

The purified anti-TfR antibody fusion protein of hSGSH was diluted to an appropriate concentration with a 50 mM acetate buffer solution (pH: 5.0) containing 0.2% BSA, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-methylumbelliferyl 2-deoxy-2-sulfamino-α-D-glucopyranoside (Carbosynth Inc.) was diluted to 5 mM with the above-described buffer solution, and 20 μL of the resulting dilution was added to each well. The mixture was stirred by a plate mixer, and then reacted at 37° C. for 2 hours. After the reaction, 0.5 mg/mL of α-Glucosidase (Oriental Yeast Co., Ltd.) was diluted with the above-described buffer solution, 20 μL of the resulting dilution was added to each well, and the mixture was reacted at 37° C. for 17 hours. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hGBA:

The purified anti-TfR antibody fusion protein of hGBA was diluted to an appropriate concentration with a 100 mM phosphate buffer solution (pH: 6.0) containing 0.1% BSA, 0.15% Triton-X 100 and 0.125% sodium taurocholate, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-methylumbelliferyl β-D-glucopyranoside (Sigma Inc.) was diluted to 3.5 mM with the above-described buffer solution, and 70 μL of the resulting dilution was added to each well. The mixture was stirred by a plate mixer, and then reacted at 37° C. for 1 hour. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hTPP-1:

The purified anti-TfR antibody fusion protein of hTPP-1 was diluted to an appropriate concentration with a 50 mM sodium formate buffer solution (pH: 3.5) containing 150 mM NaCl and 0.1% Triton-X 100, and the resulting dilution was preincubated at 37° C. for 1 hour. 7-Amino-4-methylcoumarin (AMC) (Sigma Inc.) was used as a standard, and similarly treated. After 1 hour, 20 μL of the dilution was added to each well of FluoroNunc Plate F96 (Nunc Inc.). Next, as a substrate, Ala-Ala-Phe-7-amido-4-methylcoumarin (Sigma Inc.) was diluted to 25 mM with a 100 mM acetate buffer solution (pH: 4.0) containing 150 mM NaCl and 0.1% Triton-X 100, and 40 μL of the resulting dilution was added to each well. The mixture was stirred by a plate mixer, and then reacted at 37° C. for 1 hour. After the reaction, 150 μL of a 100 mM monochloroacetate/130 mM NaOH/100 mM acetate buffer solution (pH: 4.3) was added to each well to stop the reaction, and measurement was performed at an excitation wavelength of 365 nm and a detection wavelength of 460 nm by a plate reader. The enzymatic activity was determined with one unit defined as AMC μmol/minute at 37° C.

Measurement of Activity of hGAA:

The purified anti-TfR antibody fusion protein of hGAA was diluted to an appropriate concentration with PBS (−) (pH: 7.2) containing 0.5% BSA, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-methylumbelliferyl a-D-glucopyranoside (Sigma Inc.) was diluted to 2.2 mM with a 200 mM acetate buffer solution (pH: 4.3), and 20 μL of the resulting dilution was added to each well. The mixture was stirred by a plate mixer, and then reacted at 37° C. for 1 hour. After the reaction, 200 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hNAGLU:

The purified anti-TfR antibody fusion protein of hNAGLU was diluted to an appropriate concentration with a 50 mM acetate buffer solution (pH: 4.3) containing 0.1% BSA, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-methylumbelliferyl N-acetyl-α-D-glucosaminide (Calbiochem) was diluted to 1 mM with the above-described buffer solution, and 20 μL of the resulting dilution was added to each well. The mixture was stirred by a plate mixer, and then reacted at 37° C. for 1 hour. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hGUSB:

The purified anti-TfR antibody fusion protein of hGUSB was diluted to an appropriate concentration with a 25 mM acetate buffer solution (pH: 4.5) containing 50 mM NaCl, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-methylumbelliferyl-β-D-glucuronide hydrate (Sigma Inc.) was diluted to 2 mM with the above-described buffer solution, and 20 μL of the resulting dilution was added to each well. The mixture was stirred by a plate mixer, and then reacted at 37° C. for 1 hour. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hGALC:

The purified anti-TfR antibody fusion protein of GALC was diluted to an appropriate concentration with a 50 mM acetate buffer solution (pH: 4.5) containing 125 mM NaCl and 0.5% Triton X-100, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-methylumbelliferyl-β-D-galactopyranoside (Sigma Inc.) was diluted to 1 mM with the above-described buffer solution, and 20 μL of the resulting dilution was added to each well. The mixture was stirred by a plate mixer, and then reacted at 37° C. for 1 hour. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Measurement of Activity of hFUCA1:

The purified anti-TfR antibody fusion protein of FUCA1 was diluted to an appropriate concentration with a 100 mM citrate buffer solution (pH: 5.5) containing 0.2% BSAI, and 20 μL of the resulting dilution was added to each well of FluoroNunc Plate F96 (Nunc Inc.). 4-Methylumbelliferone (4MU) (Sigma Inc.) was used as a standard. Next, as a substrate, 4-MU-α-L-fucopyranoside (Sigma Inc.) was diluted to 2 mM with the above-described buffer solution, and 20 μL of the resulting dilution was added to each well. The mixture was stirred by a plate mixer, and then reacted at 37° C. for 1 hour. After the reaction, 150 μL of a 0.05 M Glycine/NaOH buffer solution (pH: 10.6) was added to each well to stop the reaction, and measurement was performed at an excitation wavelength of 365 nm and a detection wavelength of 460 nm by a plate reader. The enzymatic activity was determined with one unit defined as 4 MU μmol/minute at 37° C.

Table 21 shows the measurements of the affinity of fusion proteins between various human lysosomal enzymes and a humanized anti-hTfR antibody to human TfR and monkey TfR, and the enzymatic activity of the fusion proteins. The affinity and the enzymatic activity were measured only for some of the fusion proteins between lysosomal enzymes and a humanized anti-hTfR antibody which had been obtained in Example 33. Specifically, the affinity to human TfR and monkey TfR was measured for 24 types of fusion proteins, and the enzymatic activity was measured for 20 types of fusion proteins.

The fusion proteins whose enzymatic activity had been measured each had an enzymatic activity as a lysosomal enzyme. Further, the fusion proteins whose affinity to human TfR had been measured each had a high affinity to human TfR, even those having the lowest affinity showed a $K_D$ value of $2.09 \times 10^{-10}$, and 19 types of fusion proteins showed a $K_D$ value of lower than $1.00 \times 10^{-12}$. Further, the fusion proteins whose affinity to monkey TfR had been measured each had a high affinity to monkey TfR, even those having the lowest affinity showed a $K_D$ value of $3.05 \times 10^{-8}$, and 12 types of fusion proteins showed a $K_D$ value of lower than $1.00 \times 10^{-12}$.

The anti-hTfR antibody used here is one whose heavy chain is a heavy chain (IgG) having as a variable region an amino acid sequence set forth as SEQ ID NO: 65, or a Fab heavy chain, and whose light chain has as a variable region an amino acid sequence set forth as SEQ ID NO: 18. These results indicate that by bringing a lysosomal enzyme into a form of a fusion protein between the lysosomal enzyme and an antibody comprising those amino acid sequences as variable regions, the lysosomal enzyme can be allowed to pass through BBB via human TfR and exhibit an enzymatic activity in the brain.

INDUSTRIAL APPLICABILITY

The anti-hTfR antibody of the present invention, when fused with physiologically active proteins, low-molecular-weight compounds and the like of interest, can make them able to pass through the blood-brain barrier, and is, therefore, highly useful in providing a means to deliver physiologically active proteins to the brain, low-molecular-weight compounds and the like which are needed to act in the central nervous system.

REFERENCE SIGNS LIST

1 Blood vessel
2 Brain parenchyma

TABLE 21

Affinity of fusion proteins between various human lysosomal enzymes and humanized anti-hTfR antibody to human TfR and monkey TfR, and enzymatic activity of the fusion proteins

| Designation of lysosomal enzyme-humanized anti-hTfR antibody fusion protein | Specific enzymatic activity (Unit/mg) | Type | kon (1/Ms) | koff (1/s) | $K_D$ (M) |
|---|---|---|---|---|---|
| Fab-GS3-GAA | 4.81 | Human TfR | $5.95 \times 10^5$ | $3.39 \times 10^{-4}$ | $2.09 \times 10^{-10}$ |
| | | Monkey TfR | $4.73 \times 10^5$ | $1.45 \times 10^{-2}$ | $3.05 \times 10^{-5}$ |
| IgG4-IDUA | 1.55 | Human TfR | $9.80 \times 10^5$ | $<1.00 \times 10^{-7}$ | $<1.00 \times 10^{-12}$ |
| | | Monkey TfR | $5.61 \times 10^5$ | $<1.00 \times 10^{-7}$ | $<1.00 \times 10^{-12}$ |
| IgG4-GS20-IDUA | 1.37 | Human TfR | $9.24 \times 10^5$ | $<1.00 \times 10^{-7}$ | $<1.00 \times 10^{-12}$ |
| | | Monkey TfR | $4.81 \times 10^5$ | $<1.00 \times 10^{-7}$ | $<1.00 \times 10^{-12}$ |
| Fab-GS3-IDUA | 1.7 | Human TfR | $2.93 \times 10^5$ | $5.28 \times 10^{-5}$ | $1.08 \times 10^{-11}$ |
| | | Monkey TfR | $2.21 \times 10^5$ | $2.92 \times 10^{-4}$ | $1.32 \times 10^{-2}$ |
| IgG4-PPT1 | 9.4 | Human TfR | $7.37 \times 10^5$ | $<1.00 \times 10^{-7}$ | $<1.00 \times 10^{-12}$ |
| | | Monkey TfR | $3.07 \times 10^5$ | $<1.00 \times 10^{-7}$ | $<1.00 \times 10^{-12}$ |
| Fab-GS3-PPT1 | 9.1 | Human TfR | $4.17 \times 10^5$ | $<1.00 \times 10^{-7}$ | $<1.00 \times 10^{-12}$ |
| | | Monkey TfR | $9.53 \times 10^4$ | $9.13 \times 10^{-4}$ | $1.32 \times 10^{-2}$ |
| Fab-GS3-ASM | 0.105 | Human TfR | $5.26 \times 10^5$ | $3.63 \times 10^{-5}$ | $6.89 \times 10^{-11}$ |
| | | Monkey TfR | $2.74 \times 10^5$ | $5.49 \times 10^{-4}$ | $2.00 \times 10^{-2}$ |
| IgG4-GS10-ARSA | 0.72 | Human TfR | $4.60 \times 10^5$ | $<1.00 \times 10^{-7}$ | $<1.00 \times 10^{-12}$ |
| | | Monkey TfR | $1.69 \times 10^5$ | $<1.00 \times 10^{-7}$ | $<1.00 \times 10^{-12}$ |
| Fab-GS3-ARSA | 0.55 | Human TfR | $6.70 \times 10^5$ | $4.02 \times 10^{-5}$ | $6.00 \times 10^{-12}$ |
| | | Monkey TfR | $2.58 \times 10^5$ | $2.81 \times 10^{-4}$ | $1.09 \times 10^{-2}$ |
| Fab-GS3-SGSH | 0.068 | Human TfR | $7.21 \times 10^5$ | $<1.00 \times 10^{-7}$ | $<1.00 \times 10^{-12}$ |
| | | Monkey TfR | $3.88 \times 10^5$ | $<1.00 \times 10^{-7}$ | $<1.00 \times 10^{-12}$ |
| IgG4-GS10-GBA | 7.0 | Human TfR | $9.57 \times 10^5$ | $<1.00 \times 10^{-7}$ | $<1.00 \times 10^{-12}$ |
| | | Monkey TfR | $4.49 \times 10^5$ | $<1.00 \times 10^{-7}$ | $<1.00 \times 10^{-12}$ |
| Fab-GS3-GBA | 9.2 | Human TfR | $6.23 \times 10^5$ | $<1.00 \times 10^{-7}$ | $<1.00 \times 10^{-12}$ |
| | | Monkey TfR | $2.99 \times 10^5$ | $1.42 \times 10^{-5}$ | $4.75 \times 10^{-2}$ |
| IgG4-TPP1 | 0.26 | Human TfR | $7.58 \times 10^5$ | $<1.00 \times 10^{-7}$ | $<1.00 \times 10^{-12}$ |
| | | Monkey TfR | $3.41 \times 10^5$ | $<1.00 \times 10^{-7}$ | $<1.00 \times 10^{-12}$ |
| IgG4-GS20-TPP1 | 0.21 | Human TfR | $6.82 \times 10^5$ | $<1.00 \times 10^{-7}$ | $<1.00 \times 10^{-12}$ |
| | | Monkey TfR | $3.02 \times 10^5$ | $<1.00 \times 10^{-7}$ | $<1.00 \times 10^{-12}$ |
| Fab-GS3-NAGLU | Not measured | Human TfR | $2.91 \times 10^5$ | $<1.00 \times 10^{-7}$ | $<1.00 \times 10^{-12}$ |
| | | Monkey TfR | $1.54 \times 10^5$ | $4.02 \times 10^{-4}$ | $2.62 \times 10^{-2}$ |
| Fab-GS3-GUSB | 8.49 | Human TfR | $4.49 \times 10^5$ | $<1.00 \times 10^{-7}$ | $<1.00 \times 10^{-12}$ |
| | | Monkey TfR | $2.50 \times 10^5$ | $<1.00 \times 10^{-7}$ | $<1.00 \times 10^{-12}$ |
| IgG4-GS10-GALC | 0.35 | Human TfR | $3.14 \times 10^4$ | $<1.00 \times 10^{-7}$ | $<1.00 \times 10^{-12}$ |
| | | Monkey TfR | $2.80 \times 10^4$ | $<1.00 \times 10^{-7}$ | $<1.00 \times 10^{-12}$ |
| Fab-GS3-GALC | 1.1 | Human TfR | $2.24 \times 10^5$ | $<1.00 \times 10^{-7}$ | $<1.00 \times 10^{-12}$ |
| | | Monkey TfR | $1.11 \times 10^5$ | $1.54 \times 10^{-4}$ | $1.40 \times 10^{-2}$ |
| IgG4-GS10-AC | Not measured | Human TfR | $5.76 \times 10^5$ | $<1.00 \times 10^{-7}$ | $<1.00 \times 10^{-12}$ |
| | | Monkey TfR | $3.01 \times 10^5$ | $<1.00 \times 10^{-7}$ | $<1.00 \times 10^{-12}$ |
| Fab-GS3-AC | Not measured | Human TfR | $5.01 \times 10^5$ | $1.05 \times 10^{-4}$ | $2.09 \times 10^{-10}$ |
| | | Monkey TfR | $2.77 \times 10^5$ | $3.27 \times 10^{-5}$ | $1.18 \times 10^{-5}$ |
| IgG4-GS10-FUCA1 | 24.2 | Human TfR | $4.66 \times 10^5$ | $<1.00 \times 10^{-7}$ | $<1.00 \times 10^{-12}$ |
| | | Monkey TfR | $2.46 \times 10^5$ | $<1.00 \times 10^{-7}$ | $<1.00 \times 10^{-12}$ |
| Fab-GS3-FUCA1 | 27.6 | Human TfR | $2.82 \times 10^5$ | $<1.00 \times 10^{-7}$ | $<1.00 \times 10^{-12}$ |
| | | Monkey TfR | $1.51 \times 10^5$ | $4.88 \times 10^{-5}$ | $3.23 \times 10^{-10}$ |
| Fab-GS3-LAMAN | Not measured | Human TfR | $7.29 \times 10^5$ | $<1.00 \times 10^{-7}$ | $<1.00 \times 10^{-12}$ |
| | | Monkey TfR | $3.57 \times 10^5$ | $<1.00 \times 10^{-7}$ | $<1.00 \times 10^{-12}$ |

3 Nerve-like cells
4 Purkinje cells

SEQUENCE LISTING FREE TEXT

SEQ ID NO:3: Amino acid sequence of exemplified linker 1

SEQ ID NO:4: Amino acid sequence of exemplified linker 2

SEQ ID NO:5: Amino acid sequence of exemplified linker 3

SEQ ID NO:6: Amino acid sequence 1 of CDR1 in the light chain of mouse anti-hTfR antibody No.3

SEQ ID NO:7: Amino acid sequence 2 of CDR1 in the light chain of mouse anti-hTfR antibody No.3

SEQ ID NO:8: Amino acid sequence 1 of CDR2 in the light chain of mouse anti-hTfR antibody No.3

SEQ ID NO:9: Amino acid sequence 2 of CDR2 in the light chain of mouse anti-hTfR antibody No.3

SEQ ID NO:10: Amino acid sequence of CDR3 in the light chain of mouse anti-hTfR antibody No.3

SEQ ID NO:11: Amino acid sequence 1 of CDR1 in the heavy chain of mouse anti-hTfR antibody No.3

SEQ ID NO:12: Amino acid sequence 2 of CDR1 in the heavy chain of mouse anti-hTfR antibody No.3

SEQ ID NO:13: Amino acid sequence 1 of CDR2 in the heavy chain of mouse anti-hTfR antibody No.3

SEQ ID NO:14: Amino acid sequence 2 of CDR2 in the heavy chain of mouse anti-hTfR antibody No.3

SEQ ID NO:15: Amino acid sequence 1 of CDR3 in the heavy chain of mouse anti-hTfR antibody No.3

SEQ ID NO:16: Amino acid sequence 2 of CDR3 in the heavy chain of mouse anti-hTfR antibody No.3

SEQ ID NO:17: Amino acid sequence 1 of the light chain variable region of humanized anti-hTfR antibody No.3

SEQ ID NO:18: Amino acid sequence 2 of the light chain variable region of humanized anti-hTfR antibody No.3

SEQ ID NO:19: Amino acid sequence 3 of the light chain variable region of humanized anti-hTfR antibody No.3

SEQ ID NO:20: Amino acid sequence 4 of the light chain variable region of humanized anti-hTfR antibody No.3

SEQ ID NO:21: Amino acid sequence 5 of the light chain variable region of humanized anti-hTfR antibody No.3

SEQ ID NO:22: Amino acid sequence 6 of the light chain variable region of humanized anti-hTfR antibody No.3

SEQ ID NO:23: Amino acid sequence of the light chain of humanized anti-hTfR antibody No.3 containing amino acid sequence 2 as the variable region SEQ ID NO:24: Nucleotide sequence encoding the amino acid sequence of the light chain of humanized anti-hTfR antibody No.3 containing amino acid sequence 2 as the variable region, synthetic sequence SEQ ID NO:25: Amino acid sequence of the light chain of humanized anti-hTfR antibody No.3 containing amino acid sequence 4 as the variable region SEQ ID NO:26: Nucleotide sequence encoding the amino acid sequence of the light chain of humanized anti-hTfR antibody No.3 containing amino acid sequence 4 as the variable region, synthetic sequence SEQ ID NO:27: Amino acid sequence of the light chain of humanized anti-hTfR antibody No.3 containing amino acid sequence 5 as the variable region SEQ ID NO:28: Nucleotide sequence encoding the amino acid sequence of the light chain of humanized anti-hTfR antibody No.3 containing amino acid sequence 5 as the variable region, synthetic sequence SEQ ID NO:29: Amino acid sequence of the light chain of humanized anti-hTfR antibody No.3 containing amino acid sequence 6 as the variable region SEQ ID NO:30: Nucleotide sequence encoding the amino acid sequence of the light chain of humanized anti-hTfR antibody No.3 containing amino acid sequence 6 as the variable region, synthetic sequence SEQ ID NO:31: Amino acid sequence 1 of the heavy chain variable region of humanized anti-hTfR antibody No.3

SEQ ID NO:32: Amino acid sequence 2 of the heavy chain variable region of humanized anti-hTfR antibody No.3

SEQ ID NO:33: Amino acid sequence 3 of the heavy chain variable region of humanized anti-hTfR antibody No.3

SEQ ID NO:34: Amino acid sequence 4 of the heavy chain variable region of humanized anti-hTfR antibody No.3

SEQ ID NO:35: Amino acid sequence 5 of the heavy chain variable region of humanized anti-hTfR antibody No.3

SEQ ID NO:36: Amino acid sequence 6 of the heavy chain variable region of humanized anti-hTfR antibody No.3

SEQ ID NO:37: Amino acid sequence of the heavy chain of humanized anti-hTfR antibody No.3 containing amino acid sequence 2 as the variable region SEQ ID NO:38: Nucleotide sequence encoding the amino acid sequence of the heavy chain of humanized anti-hTfR antibody No.3 containing amino acid sequence 2 as the variable region, synthetic sequence SEQ ID NO:39: Amino acid sequence of the heavy chain (IgG4) of humanized anti-hTfR antibody No.3 containing amino acid sequence 2 as the variable region SEQ ID NO:40: Nucleotide sequence encoding the amino acid sequence of the heavy chain (IgG4) of humanized anti-hTfR antibody No.3 containing amino acid sequence 2 as the variable region, synthetic sequence SEQ ID NO:41: Primer hTfR5', synthetic sequence SEQ ID NO:42: Primer hTfR3', synthetic sequence SEQ ID NO:43: Primer Hyg-Sfi5', synthetic sequence SEQ ID NO:44: Primer Hyg-BstX3', synthetic sequence SEQ ID NO:45: Nucleotide sequence of the DNA in which a neomycin resistance gene flanked by loxP sequences was placed on the cDNA's 3' side of a cDNA encoding chimeric hTfR, synthetic sequence SEQ ID NO:46: 5'-arm sequence of targeting vector, synthetic sequence SEQ ID NO:47: 3'-arm sequence of targeting vector, synthetic sequence SEQ ID NO:48: Amino acid sequence of the light chain variable region of mouse anti-hTfR antibody No.3

SEQ ID NO:49: Amino acid sequence of the heavy chain variable region of mouse anti-hTfR antibody No.3

SEQ ID NO:51: Amino acid sequence of fusion protein of heavy chain of anti-hTfR antibody No.3 (humanized 2) and hI2S, synthetic sequence SEQ ID NO:52: Nucleotide sequence encoding the amino acid sequence of fusion protein of heavy chain of anti-hTfR antibody No.3 (humanized 2) and hI2S, synthetic sequence SEQ ID NO: 53: Amino acid sequence of the fusion protein of heavy chain of humanized anti-hTfR antibody No. 3N and hI2S SEQ ID NO: 54: Nucleotide sequence encoding the amino acid sequence of fusion protein of heavy chain of humanized anti-hTfR antibody No. 3N and hI2S, synthetic sequence SEQ ID NO: 57: Amino acid sequence of the fusion protein of heavy chain of humanized anti-hTfR antibody No. 3N and hGAA SEQ ID NO: 58: Amino acid sequence of the fusion protein of heavy chain (IgG4) of humanized anti-hTfR antibody No. 3N and hGAA SEQ ID NO: 59: Nucleotide sequence encoding the amino acid sequence of fusion protein of heavy chain (IgG4) of humanized anti-hTfR antibody No. 3N and hGAA, synthetic sequence SEQ ID NO: 60: Amino acid sequence of single-chain humanized anti-hTfR antibody No. 3N SEQ ID NO: 61: Amino acid sequence of the Fab heavy chain of humanized anti-hTfR antibody No. 3N SEQ ID NO: 62: Amino acid sequence 1 of CDR1 in the heavy chain of humanized anti-hTfR antibody No. 3N SEQ ID NO: 63: Amino acid sequence 2 of CDR1 in the heavy chain of humanized anti-hTfR antibody No. 3N SEQ ID NO: 64: Amino acid sequence of framework region 3 in the heavy chain of humanized anti-hTfR antibody No. 3N SEQ ID NO: 65: Amino acid sequence of the heavy chain variable region of humanized anti-hTfR antibody No. 3N SEQ ID NO: 66: Amino acid sequence of the heavy chain of humanized anti-hTfR antibody No. 3N SEQ ID NO: 67: Nucleotide sequence encoding the amino acid sequence of the heavy chain of humanized anti-hTfR antibody No. 3N, synthetic sequence SEQ ID NO: 68: Amino acid sequence of the heavy chain (IgG4) of humanized anti-hTfR antibody No. 3N SEQ ID NO: 69: Nucleotide sequence encoding the amino acid sequence of the heavy chain (IgG4) of humanized anti-hTfR antibody No. 3N, synthetic sequence SEQ ID NO: 70: One example of the amino acid sequence of the Fc region of human IgG SEQ ID NO: 71: Amino acid sequence of human IgG Fc region-added Fab heavy chain of humanized anti-hTfR antibody 3N SEQ ID NO: 72: Nucleotide sequence encoding the amino acid sequence of human IgG Fc region-added Fab heavy chain of humanized anti-hTfR antibody 3N, synthetic sequence SEQ ID NO: 73: Amino acid sequence of framework region 3 in the heavy chain of humanized anti-hTfR antibody No. 3

SEQ ID NO: 74: Amino acid sequence of albumin-binding domain

SEQ ID NO: 75: Amino acid sequence 1 of human IDUA

SEQ ID NO: 76: Amino acid sequence 2 of human IDUA

SEQ ID NO: 77: Amino acid sequence of human PPT-1

SEQ ID NO: 78: Amino acid sequence of human ASM

SEQ ID NO: 79: Amino acid sequence of human ARSA

SEQ ID NO: 80: Amino acid sequence of human SGSH

SEQ ID NO: 81: Amino acid sequence of human GBA

SEQ ID NO: 82: Amino acid sequence of human TPP-1

SEQ ID NO: 83: Amino acid sequence of human NAGLU

SEQ ID NO: 84: Amino acid sequence of human GUSB

SEQ ID NO: 85: Amino acid sequence of human GALC

SEQ ID NO: 86: Amino acid sequence of human AC

SEQ ID NO: 87: Amino acid sequence of human FUCA1

SEQ ID NO: 88: Amino acid sequence of human LAMAN

SEQ ID NO: 89: Amino acid sequence of fusion protein between the Fab heavy chain of humanized anti-hTfR antibody No. 3N and hGAA, Fab HC-GS3-GAA SEQ ID NO: 90: Amino acid sequence of fusion protein between the heavy chain (IgG4) of humanized anti-hTfR antibody No. 3N and hIDUA, IgG4 HC-IDUA SEQ ID NO: 91: Amino acid sequence of fusion protein between the heavy chain (IgG4) of humanized anti-hTfR antibody No. 3N and hIDUA, IgG4 HC-GS8-IDUA SEQ ID NO: 92: Amino acid sequence of fusion protein between the heavy chain (IgG4) of humanized anti-hTfR antibody No. 3N and hIDUA, IgG4 HC-G520-IDUA SEQ ID NO: 93: Amino acid sequence of fusion protein between the Fab heavy chain of humanized anti-hTfR antibody No. 3N and hIDUA, Fab HC-GS3-IDUA SEQ ID NO: 94: Amino acid sequence of fusion protein between the Fab heavy chain of humanized anti-hTfR antibody No. 3N and hIDUA, Fab HC-GS5-IDUA SEQ ID NO: 95: Amino acid sequence of fusion protein between the Fab heavy chain of humanized anti-hTfR antibody No. 3N and hIDUA, Fab HC-GS10-IDUA SEQ ID NO: 96: Amino acid sequence of fusion protein between the Fab heavy chain of humanized anti-hTfR antibody No. 3N and hIDUA, Fab HC-G520-IDUA SEQ ID NO: 97: Amino acid sequence of fusion protein between the Fab heavy chain of humanized anti-hTfR antibody No. 3N and hIDUA, Tandem Fab HC-IDUA SEQ ID NO: 98: Amino acid sequence of single-chain humanized anti-hTfR antibody No. 3N(2)

SEQ ID NO: 99: Amino acid sequence of fusion protein between single-chain humanized anti-hTfR antibody No. 3N and IDUA, scFab-IDUA SEQ ID NO: 100: Amino acid sequence of fusion protein between the heavy chain (IgG4) of humanized anti-hTfR antibody No. 3N and hPPT-1, IgG4 HC-PPT1

SEQ ID NO: 101: Amino acid sequence of fusion protein between the heavy chain (IgG4) of humanized anti-hTfR antibody No. 3N and hPPT-1, IgG4 HC-GS5-PPT1

SEQ ID NO: 102: Amino acid sequence of fusion protein between the heavy chain (IgG4) of humanized anti-hTfR antibody No. 3N and hPPT-1, IgG4 HC-GS10-PPT1

SEQ ID NO: 103: Amino acid sequence of fusion protein between the heavy chain (IgG4) of humanized anti-hTfR antibody No. 3N and hPPT-1, IgG4 HC-GS20-PPT1

SEQ ID NO: 104: Amino acid sequence of fusion protein between the Fab heavy chain of humanized anti-hTfR antibody No. 3N and hPPT-1, Fab HC-GS3-PPT1

SEQ ID NO: 105: Amino acid sequence of fusion protein between the Fab heavy chain of humanized anti-hTfR antibody No. 3N and hPPT-1, Tandem Fab HC-PPT1

SEQ ID NO: 106: Amino acid sequence of fusion protein between the heavy chain (IgG4) of humanized anti-hTfR antibody No. 3N and hASM, IgG4 HC-ASM SEQ ID NO: 107: Amino acid sequence of fusion protein between the heavy chain (IgG4) of humanized anti-hTfR antibody No. 3N and hASM, IgG4 HC-GS5-ASM SEQ ID NO: 108: Amino acid sequence of fusion protein between the heavy chain (IgG4) of humanized anti-hTfR antibody No. 3N and hASM, IgG4 HC-GS10-ASM SEQ ID NO: 109: Amino acid sequence of fusion protein between the heavy chain (IgG4) of humanized anti-hTfR antibody No. 3N and hASM, IgG4 HC-GS20-ASM SEQ ID NO: 110: Amino acid sequence of fusion protein between the Fab heavy chain of humanized anti-hTfR antibody No. 3N and hASM, Fab HC-GS3-ASM SEQ ID NO: 111: Amino acid sequence of fusion protein between the Fab heavy chain of humanized anti-hTfR antibody No. 3N and hASM, Fab HC-GS5-ASM SEQ ID NO: 112: Amino acid sequence of fusion protein between the Fab heavy chain of humanized anti-hTfR antibody No. 3N and hASM, Fab HC-GS10-ASM SEQ ID NO: 113: Amino acid sequence of fusion protein between the Fab heavy chain of humanized anti-hTfR antibody No. 3N and hASM, Fab HC-GS20-ASM SEQ ID NO: 114: Amino acid sequence of fusion protein between the Fab heavy chain of humanized anti-hTfR antibody No. 3N and hASM, Tandem Fab HC-ASM SEQ ID NO: 115: Amino acid sequence of fusion protein between the heavy chain (IgG4) of humanized anti-hTfR antibody No. 3N and hARSA, IgG4 HC-ARSA SEQ ID NO: 116: Amino acid sequence of fusion protein between the heavy chain (IgG4) of humanized anti-hTfR antibody No. 3N and hARSA, IgG4 HC-GS5-ARSA SEQ ID NO: 117: Amino acid sequence of fusion protein between the heavy chain (IgG4) of humanized anti-hTfR antibody No. 3N and hARSA, IgG4 HC-GS10-ARSA SEQ ID NO: 118: Amino acid sequence of fusion protein between the heavy chain (IgG4) of humanized anti-hTfR antibody No. 3N and hARSA, IgG4 HC-GS20-ARSA SEQ ID NO: 119: Amino acid sequence of fusion protein between the Fab heavy chain of humanized anti-hTfR antibody No. 3N and hARSA, Fab HC-GS3-ARSA SEQ ID NO: 120: Amino acid sequence of fusion protein between the Fab heavy chain of humanized anti-hTfR antibody No. 3N and hARSA, Fab HC-GS5-ARSA SEQ ID NO: 121: Amino acid sequence of fusion protein between the Fab heavy chain of humanized anti-hTfR antibody No. 3N and hARSA, Fab HC-GS10-ARSA SEQ ID NO: 122: Amino acid sequence of fusion protein between the Fab heavy chain of humanized anti-hTfR antibody No. 3N and hARSA, Fab HC-GS20-ARSA SEQ ID NO: 123: Amino acid sequence of fusion protein between the Fab heavy chain of humanized anti-hTfR antibody No. 3N and hARSA, Tandem Fab HC-ARSA SEQ ID NO: 124: Amino acid sequence of fusion protein between the heavy chain (IgG4) of humanized anti-hTfR antibody No. 3N and hSGSH, IgG4 HC-SGSH SEQ ID NO: 125: Amino acid sequence of fusion protein between the heavy chain (IgG4) of humanized anti-hTfR antibody No. 3N and hSGSH, IgG4 HC-GS5-SGSH SEQ ID NO: 126: Amino acid sequence of fusion protein between the heavy chain (IgG4) of humanized anti-hTfR antibody No. 3N and hSGSH, IgG4 HC-GS10-SGSH SEQ ID NO: 127: Amino acid sequence of fusion protein between the heavy chain (IgG4) of humanized anti-hTfR antibody No. 3N and hSGSH, IgG4 HC-GS20-SGSH SEQ ID NO: 128: Amino acid sequence of fusion protein between the Fab heavy chain of humanized anti-hTfR antibody No. 3N and hSGSH, Fab HC-GS3-SGSH SEQ ID NO: 129: Amino acid sequence of fusion protein between the Fab heavy chain of humanized anti-hTfR antibody No. 3N and hSGSH, Tandem Fab HC-SGSH SEQ ID NO: 130: Amino acid sequence of fusion protein between the heavy chain (IgG4) of humanized anti-hTfR antibody No. 3N and hGBA, IgG4 HC-GBA SEQ ID NO: 131: Amino acid sequence of fusion protein between the heavy chain (IgG4) of humanized anti-hTfR antibody No. 3N and hGBA, IgG4 HC-GS5-GBA SEQ ID NO: 132: Amino acid sequence of fusion protein between the heavy chain (IgG4) of humanized anti-hTfR antibody No. 3N and hGBA, IgG4 HC-GS10-GBA SEQ ID NO: 133: Amino acid sequence of fusion protein between the heavy chain (IgG4) of humanized anti-hTfR antibody No. 3N and hGBA, IgG4 HC-GS20-GBA SEQ ID NO: 134: Amino acid sequence of fusion protein between the Fab heavy chain of humanized anti-hTfR antibody No. 3N and hGBA, Fab HC-GS3-GBA SEQ ID NO: 135: Amino acid sequence of fusion protein between the Fab heavy chain of humanized anti-hTfR antibody No. 3N and hGBA, Tandem Fab HC-GBA SEQ ID NO: 136: Amino acid sequence of fusion protein between the heavy chain (IgG4) of humanized anti-hTfR antibody No. 3N and hTPP-1, IgG4 HC-TPP1

SEQ ID NO: 137: Amino acid sequence of fusion protein between the heavy chain (IgG4) of humanized anti-hTfR antibody No. 3N and hTPP-1, IgG4 HC-GS5-TPP1

SEQ ID NO: 138: Amino acid sequence of fusion protein between the heavy chain (IgG4) of humanized anti-hTfR antibody No. 3N and hTPP-1, IgG4 HC-GS 10-TPP1

SEQ ID NO: 139: Amino acid sequence of fusion protein between the heavy chain (IgG4) of humanized anti-hTfR antibody No. 3N and hTPP-1, IgG4 HC-GS20-TPP1

SEQ ID NO: 140: Amino acid sequence of fusion protein between the Fab heavy chain of humanized anti-hTfR antibody No. 3N and hTPP-1, Fab HC-GS3-TPP1

SEQ ID NO: 141: Amino acid sequence of fusion protein between the Fab heavy chain of humanized anti-hTfR antibody No. 3N and hTPP-1, Tandem Fab HC-TPP1

SEQ ID NO: 142: Amino acid sequence of fusion protein between the heavy chain (IgG4) of humanized anti-hTfR antibody No. 3N and hNAGLU, IgG4 HC-NAGLU SEQ ID NO: 143: Amino acid sequence of fusion protein between the heavy chain (IgG4) of humanized anti-hTfR antibody No. 3N and hNAGLU, IgG4 HC-GS5-NAGLU SEQ ID NO: 144: Amino acid sequence of fusion protein between the heavy chain (IgG4) of humanized anti-hTfR antibody No. 3N and hNAGLU, IgG4 HC-GS10-NAGLU SEQ ID NO: 145: Amino acid sequence of fusion protein between the heavy chain (IgG4) of humanized anti-hTfR antibody No. 3N and hNAGLU, IgG4 HC-GS20-NAGLU SEQ ID NO: 146: Amino acid sequence of fusion protein between the Fab heavy chain of humanized anti-hTfR antibody No. 3N and hNAGLU, Fab HC-GS3-NAGLU SEQ ID NO: 147: Amino acid sequence of fusion protein between the Fab heavy chain of humanized anti-hTfR antibody No. 3N and hNAGLU, Fab HC-GS5-NAGLU SEQ ID NO: 148: Amino acid sequence of fusion protein between the Fab heavy chain of humanized anti-hTfR antibody No. 3N and hNAGLU, Fab HC-GS10-NAGLU SEQ ID NO: 149: Amino acid sequence of fusion protein between the Fab heavy chain of humanized anti-hTfR antibody No. 3N and hNAGLU, Fab HC-GS20-NAGLU SEQ ID NO: 150: Amino acid sequence of fusion protein between the heavy chain (IgG4) of humanized anti-hTfR antibody No. 3N and hGUSB, IgG4 HC-GUSB SEQ ID NO: 151: Amino acid sequence of fusion protein between the heavy chain (IgG4) of humanized anti-hTfR antibody No. 3N and hGUSB, IgG4 HC-GS5-GUSB SEQ ID NO: 152: Amino acid sequence of fusion protein between the heavy chain (IgG4) of humanized anti-hTfR antibody No. 3N and hGUSB, IgG4 HC-GS10-GUSB SEQ ID NO: 153: Amino acid sequence of fusion protein between the heavy chain (IgG4) of humanized anti-hTfR antibody No. 3N and hGUSB, IgG4 HC-GS20-GUSB SEQ ID NO: 154: Amino acid sequence of fusion protein between the Fab heavy chain of humanized anti-hTfR antibody No. 3N and hGUSB, Fab HC-GS3-GUSB SEQ ID NO: 155: Amino acid sequence of fusion protein between the Fab heavy chain of humanized anti-hTfR antibody No. 3N and hGUSB, Fab HC-GS5-GUSB SEQ ID NO: 156: Amino acid sequence of fusion protein between the Fab heavy chain of humanized anti-hTfR antibody No. 3N and hGUSB, Fab HC-GS10-GUSB SEQ ID NO: 157: Amino acid sequence of fusion protein between the Fab heavy chain of humanized anti-hTfR antibody No. 3N and hGUSB, Fab HC-GS20-GUSB SEQ ID NO: 158: Amino acid sequence of fusion protein between the heavy chain (IgG4) of humanized anti-hTfR antibody No. 3N and hGALC, IgG4 HC-GALC SEQ ID NO: 159: Amino acid sequence of fusion protein between the heavy chain (IgG4) of humanized anti-hTfR antibody No. 3N and hGALC, IgG4 HC-GS5-GALC SEQ ID NO: 160: Amino acid sequence of fusion protein between the heavy chain (IgG4) of humanized anti-hTfR antibody No. 3N and hGALC, IgG4 HC-GS10-GALC SEQ ID NO: 161: Amino acid sequence of fusion protein between the heavy chain (IgG4) of humanized anti-hTfR antibody No. 3N and hGALC, IgG4 HC-GS20-GALC SEQ ID NO: 162: Amino acid sequence of fusion protein between the Fab heavy chain of humanized anti-hTfR antibody No. 3N and hGALC, Fab HC-GS3-GALC SEQ ID NO: 163: Amino acid sequence of fusion protein between the Fab heavy chain of humanized anti-hTfR antibody No. 3N and hGALC, Fab HC-GS5-GALC SEQ ID NO: 164: Amino acid sequence of fusion protein between the Fab heavy chain of humanized anti-hTfR antibody No. 3N and hGALC, Fab HC-GS10-GALC SEQ ID NO: 165: Amino acid sequence of fusion protein between the Fab heavy chain of humanized anti-hTfR antibody No. 3N and hGALC, Fab HC-GS20-GALC SEQ ID NO: 166: Amino acid sequence of fusion protein between the heavy chain (IgG4) of humanized anti-hTfR antibody No. 3N and hAC, IgG4 HC-AC SEQ ID NO: 167: Amino acid sequence of fusion protein between the heavy chain (IgG4) of humanized anti-hTfR antibody No. 3N and hAC, IgG4 HC-GS5-AC SEQ ID NO: 168: Amino acid sequence of fusion protein between the heavy chain (IgG4) of humanized anti-hTfR antibody No. 3N and hAC, IgG4 HC-GS10-AC SEQ ID NO: 169: Amino acid sequence of fusion protein between the heavy chain (IgG4) of humanized anti-hTfR antibody No. 3N and hAC, IgG4 HC-GS20-AC SEQ ID NO: 170: Amino acid sequence of fusion protein between the Fab heavy chain of humanized anti-hTfR antibody No. 3N and hAC, Fab HC-GS3-AC SEQ ID NO: 171: Amino acid sequence of fusion protein between the Fab heavy chain of humanized anti-hTfR antibody No. 3N and hAC, Fab HC-GS5-AC SEQ ID NO: 172: Amino acid sequence of fusion protein between the Fab heavy chain of humanized anti-hTfR antibody No. 3N and hAC, Fab HC-GS 10-AC SEQ ID NO: 173: Amino acid sequence of fusion protein between the Fab heavy chain of humanized anti-hTfR antibody No. 3N and hAC, Fab HC-GS20-AC SEQ ID NO: 174: Amino acid sequence of fusion protein between the heavy chain (IgG4) of humanized anti-hTfR antibody No. 3N and hFUCA1, IgG4 HC-FUCA1

SEQ ID NO: 175: Amino acid sequence of fusion protein between the heavy chain (IgG4) of humanized anti-hTfR antibody No. 3N and hFUCA1, IgG4 HC-GS5-FUCA1

SEQ ID NO: 176: Amino acid sequence of fusion protein between the heavy chain (IgG4) of humanized anti-hTfR antibody No. 3N and hFUCA1, IgG4 HC-GS10-FUCA1

SEQ ID NO: 177: Amino acid sequence of fusion protein between the heavy chain (IgG4) of humanized anti-hTfR antibody No. 3N and hFUCA1, IgG4 HC-GS20-FUCA1

SEQ ID NO: 178: Amino acid sequence of fusion protein between the Fab heavy chain of humanized anti-hTfR antibody No. 3N and hFUCA1, Fab HC-GS3-FUCA1

SEQ ID NO: 179: Amino acid sequence of fusion protein between the Fab heavy chain of humanized anti-hTfR antibody No. 3N and hFUCA1, Fab HC-GS5-FUCA1

SEQ ID NO: 180: Amino acid sequence of fusion protein between the Fab heavy chain of humanized anti-hTfR antibody No. 3N and hFUCA1, Fab HC-GS10-FUCA1

SEQ ID NO: 181: Amino acid sequence of fusion protein between the Fab heavy chain of humanized anti-hTfR antibody No. 3N and hFUCA1, Fab HC-GS20-FUCA1

SEQ ID NO: 182: Amino acid sequence of fusion protein between the heavy chain (IgG4) of humanized anti-hTfR antibody No. 3N and hLAMAN, IgG4 HC-LAMAN SEQ ID NO: 183: Amino acid sequence of fusion protein between the heavy chain (IgG4) of humanized anti-hTfR antibody No. 3N and hLAMAN, IgG4 HC-GS5-LAMAN SEQ ID NO: 184: Amino acid sequence of fusion protein between the heavy chain (IgG4) of humanized anti-hTfR antibody No. 3N and hLAMAN, IgG4 HC-GS10-LAMAN SEQ ID NO: 185: Amino acid sequence of fusion protein between the heavy chain (IgG4) of humanized anti-hTfR antibody No. 3N and hLAMAN, IgG4 HC-GS20-LAMAN SEQ ID NO: 186: Amino acid sequence of fusion protein between the Fab heavy chain of humanized anti-hTfR antibody No. 3N and hLAMAN, Fab HC-GS3-LAMAN SEQ ID NO: 187: Amino acid sequence of fusion protein between the Fab heavy chain of humanized anti-hTfR antibody No. 3N and hLAMAN, Fab HC-GS5-LAMAN SEQ ID NO: 188: Amino acid sequence of fusion protein between the Fab heavy chain of humanized anti-hTfR antibody No. 3N and hLAMAN, Fab HC-GS10-LAMAN SEQ ID NO: 189: Amino acid sequence of fusion protein between the Fab heavy chain of humanized anti-hTfR antibody No. 3N and hLAMAN, Fab HC-GS20-LAMAN

SEQUENCE LISTING (189 sequences)

SEQ ID NO: 1 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 2 - protein, 760 aa, Macaca fascicularis
MMDQARSAFSNLFGGEPLSYTRFSLARQVDGDNSHVEMKLAVDDEENADNNTKANGTKPKRCGGNICYGTIAVIIFFLIGFMIGYLGYCKGVEPKTECERLAGTESPAREEPEEDFPAAPRLYWDDLKRKLSEKLDTTDFTSTIKLLNENLYVPREAGSQKDENLALYIENQFREFKLSKVWRDQHFVKIQVKDSAQNSVIIVDKNGGLVYLVENPGGYVAYSKAATVTGKLVHANFGTKKDFEDLDSPVNGSIVIVRAGKITFAEKVANAESLNAIGVLIYMDQTKFPIVKADLSFFGHAHLGTGDPYTPGFPSFNHTQFPPSQSSGLPNIPVQTISRAAAEKLFGNMEGDCPSDWKTDSTCKMVTSENKSVKLTVSNVLKETKILNIFGVIKGFVEPDHYVVVGAQRDAWGPGAAKSSVGTALLLKLAQMFSDMVLKDGFQPSRSIIFASWSAGDFGSVGATEWLEGYLSSLHLKAFTYINLDKAVLGTSNFKVSASPLLYTLIEKTMQDVKHPVTGRSLYQDSNWASKVEKLTLDNAAFPFLAYSGIPAVSFCFCEDTDYPYLGTTMDTYKELVERIPELNKVARAAAEVAGQFVIKLTHDTELNLDYERYNSQLLLFLRDLNQYRADVKEMGLSLQWLYSARGDFFRATSRLTTDFRNAEKRDKFVMKKLNDRVMRVEYYFLSPYVSPKESPFRHVFWGSGSHTLSALLESLKLRRQNNSAFNETLFRNQLALATWTIQGAANALSGDVWDIDNEF

SEQ ID NO: 3 - protein, 5 aa, Artificial Sequence
  Amino acid sequence of an exemplified linker 1
GGGGS

SEQ ID NO: 4 - protein, 6 aa, Artificial Sequence
  Amino acid sequence of an exemplified linker 2
GGGGGS

SEQ ID NO: 5 - protein, 5 aa, Artificial Sequence
  Amino acid sequence of an exemplified linker 3
SGGGG

SEQ ID NO: 6 - protein, 11 aa, Artificial Sequence
  Amino acid sequence 1 of CDR 1 in the light chain of mouse anti-hTfR antibody No.3
QSLVHSNGNTY

SEQ ID NO: 7 - protein, 16 aa, Artificial Sequence
  Amino acid sequence 2 of CDR 1 in the light chain of mouse anti-hTfR antibody No.3
RSSQSLVHSNGNTYLH

SEQ ID NO: 8 - protein, 6 aa, Artificial Sequence
  Amino acid sequence 1 of CDR 2 in the light chain of mouse anti-hTfR antibody No.3
KVSNRF

SEQ ID NO: 9 - protein, 7 aa, Artificial Sequence
  Amino acid sequence 2 of CDR 2 in the light chain of mouse anti-hTfR antibody No.3
KVSNRFS

SEQ ID NO: 10 - protein, 9 aa, Artificial Sequence
  Amino acid sequence of CDR 3 in the light chain of mouse anti-hTfR antibody No. 3
SQSTHVPWT

SEQ ID NO: 11 - protein, 5 aa, Artificial Sequence
  Amino acid sequence 1 of CDR 1 in the heavy chain of mouse anti-hTfR antibody No.3
NYWLG

SEQ ID NO: 12 - protein, 8 aa, Artificial Sequence
  Amino acid sequence 2 of CDR 1 in the heavy chain of mouse anti-hTfR antibody No.3
GYSFTNYW

SEQ ID NO: 13 - protein, 8 aa, Artificial Sequence
  Amino acid sequence 1 of CDR 2 in the heavy chain of mouse anti-hTfR antibody No.3
IYPGGDYP

SEQ ID NO: 14 - protein, 17 aa, Artificial Sequence
  Amino acid sequence 2 of CDR 2 in the heavy chain of mouse anti-hTfR antibody No.3
DIYPGGDYPTYSEKFKV

SEQ ID NO: 15 - protein, 9 aa, Artificial Sequence
  Amino acid sequence 1 of CDR 3 in the heavy chain of mouse anti-hTfR antibody No.3
SGNYDEVAY

SEQ ID NO: 16 - protein, 11 aa, Artificial Sequence
  Amino acid sequence 2 of CDR 3 in the heavy chain of mouse anti-hTfR antibody No.3
ARSGNYDEVAY

SEQ ID NO: 17 - protein, 112 aa, Artificial Sequence
  Amino acid sequence 1 of the variable region of the light chain of humanized anti-hTfR antibody No.3
DVVMTQSPLSLPVTLGQPASISCRSSQSLVHSNGNTYLHWFQQRPGQSPRRLIYKVSNRFSGVPDRFSGSGSGTDFTLKISRVEAEDVGVYYCSQSTHVPWTFGGGTKVEIK

SEQ ID NO: 18 - protein, 112 aa, Artificial Sequence
  Amino acid sequence 2 of the variable region of the light chain of humanized anti-hTfR antibody No.3
DIVMTQTPLSLSVTPGQPASISCRSSQSLVHSNGNTYLHWYLQKPGQSPQLLIYKVSNRFSGVPDRFSGSGSGTDFTLKISRVEAEDVGVYYCSQSTHVPWTFGQGTKVEIK

SEQ ID NO: 19 - protein, 112 aa, Artificial Sequence
  Amino acid sequence 3 of the variable region of the light chain of humanized anti-hTfR antibody No.3
DIVMTQTPLSSPVTLGQPASISCRSSQSLVHSNGNTYLHWLQQRPGQPPRLLIYKVSNRFSGVPDRFSGSGAGTDFTLKISRVEAEDVGVYYCSQSTHVPWTFGQGTKLEIK

SEQ ID NO: 20 - protein, 112 aa, Artificial Sequence
  Amino acid sequence 4 of the variable region of the light chain of humanized anti-hTfR antibody No.3
DIVMTQSPLSLPVTPGEPASISCRSSQSLVHSNGNTYLHWYLQKPGQSPQLLIYKVSNRFSGVPDRFSGSGSGTDFTLKISRVEAEDVGVYYCSQSTHVPWTFGQGTKVEIK

SEQ ID NO: 21 - protein, 112 aa, Artificial Sequence
  Amino acid sequence 5 of the variable region of the light chain of humanized anti-hTfR antibody No.3
DIVMTQTPLSLPVTPGEPASISCRSSQSLVHSNGNTYLHWYLQKPGQSPQLLIYKVSNRFSGVPDRFSGSGSGTDFTLKISRVEAEDVGVYYCSQSTHVPWTFGQGTRLEIK

SEQ ID NO: 22 - protein, 112 aa, Artificial Sequence
  Amino acid sequence 6 of the variable region of the light chain of humanized anti-hTfR antibody No.3
DIVMTQTPLSLSVTPGQPASISCRSSQSLVHSNGNTYLHWYLQKPGQSPQLLIYKVSNRFSGVPDRFSGSGSGTDFTLKISRVEAEDVGVFFCSQSTHVPWTFGQGTKVEIK

SEQ ID NO: 23 - protein, 219 aa, Artificial Sequence
  Amino acid sequence of the light chain of humanized anti-hTfR antibody No.3 containing amino acid sequence 2 as the variable region
DIVMTQTPLSLSVTPGQPASISCRSSQSLVHSNGNTYLHWYLQKPGQSPQLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - DNA, 740 bp, Artificial Sequence
  Nucleotide sequence encoding the amino acid sequence of the light chain of humanized anti-hTfR antibody No.3 containing amino acid sequence 2 as the variable region, synthetic sequence
acgcgtgccgccaccatgggctggagctggattctgctgttcctcctgagcgtgacagcaggagtgcacagcgacatcgtgatgacccagactcccctgagcctgagcgtgacacctggccagcctgccagcatcagctgcagaagctctcagagcctggtgcacagcaacggcaacacctacctgcactggtatctgcagaagcccggccagagccctcagctgctgatctacaaggtgtccaacagattcagcggcgtgcccgacagattctccggcagcggctctggcaccgacttcaccctgaagatttccagagtggaagccgaggacgtgggcgtgtactactgcagccagagcacccacgtgccctggacattcggccagggcaccaaggtggaaatcaagagaaccgtggccgctcccagcgtgttcatcttcccacctagcgacgagcagctgaagtccggcacagcctctgtcgtgtgcctgctgaacaacttctacccccgcgaggccaaggtgcagtggaaggtggacaacgccctgcagagcggcaacagccaggaaagcgtgaccgagcaggactccaaggacagcacctacagcctgagcagcaccctgaccctgagcaaggccgactacgagaagcacaaggtgtacgcctgcgaagtgacccaccagggcctgtctagccccgtgaccaagagcttcaacagaggcgagtgctaagcggccgc

SEQ ID NO: 25 - protein, 219 aa, Artificial Sequence
  Amino acid sequence of the light chain of humanized anti-hTfR antibody No.3 containing amino acid sequence 4 as the variable region
DIVMTQSPLSLPVTPGEPASISCRSSQSLVHSNGNTYLHWYLQKPGQSPQLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - DNA, 740 bp, Artificial Sequence
  Nucleotide sequence encoding the amino acid sequence of the light chain of humanized anti-hTfR antibody No.3 containing amino acid sequence 4 as the variable region, synthetic sequence
acgcgtgccgccaccatgggctggagctggattctgctgttcctcctgagcgtgacagcaggagtgcacagcgacatcgtgatgacccagagccccctgagcctgcctgtgacacctggcgagcctgccagcatcagctgcagatctagccagagcctggtgcacagcaacggcaacacctacctgcactggtatctgcagaagcccggccagagccctcagctgctgatctacaaggtgtccaacagattcagcggcgtgcccgacagattctccggcagcggctctggcaccgacttcaccctgaagatctccagagtggaagccgaggacgtgggcgtgtactactgcagccagagcacccacgtgccctggacattcggccagggcaccaaggtggaaatcaagagaaccgtggccgctcccagcgtgttcatcttcccacctagcgacgagcagctgaagtccggcacagcctctgtcgtgtgcctgctgaacaacttctacccccgcgaggccaaggtgcagtggaaggtggacaacgccctgcagagcggcaacagccaggaaagcgtgaccgagcaggactccaaggacagcacctacagcctgagcagcaccctgaccctgagcaaggccgactacgagaagcacaaggtgtacgcctgcgaagtgacccaccagggcctgtctagccccgtgaccaagagcttcaacagaggcgagtgctaagcggccgc

SEQ ID NO: 27 - protein, 219 aa, Artificial Sequence
  Amino acid sequence of the light chain of humanized anti-hTfR antibody No.3 containing amino acid sequence 5 as the variable region
DIVMTQTPLSLPVTPGEPASISCRSSQSLVHSNGNTYLHWYLQKPGQSPQLLIYKVSNRFSGVPDRFSGSGSGTDFTLKISRVEAEDVGVYYCSQSTHVPWTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28 - DNA, 740 bp, Artificial Sequence
  Nucleotide sequence encoding the amino acid sequence of the light chain of humanized anti-hTfR antibody No.3 containing amino acid sequence 5 as the variable region, synthetic sequence
acgcgtgccgccaccatgggctggagctggattctgctgttcctcctgagcgtgacagcaggagtgcacagcgacatcgtgatgacccagacacccctgagcctgcctgtgacacctggcgagcctgccagcatcagctgcagatctagccagagcctggtgcacagcaacggcaacacctacctgcactggtatctgcagaagcccggccagagccctcagctgctgatctacaaggtgtccaacagattcagcggcgtgcccgacagattctccggcagcggctctggcaccgacttcaccctgaagatctccagagtggaagccgaggacgtgggcgtgtactactgcagccagagcacccacgtgccctggacattcggccagggcaccaggctggaaatcaagagaaccgtggccgctcccagcgtgttcatcttcccacctagcgacgagcagctgaagtccggcacagcctctgtcgtgtgcctgctgaacaacttctacccccgcgaggccaaggtgcagtggaaggtggacaacgccctgcagagcggcaacagccaggaaagcgtgaccgagcaggactccaaggacagcacctacagcctgagcagcaccctgaccctgagcaaggccgactacgagaagcacaaggtgtacgcctgcgaagtgacccaccagggcctgtctagccccgtgaccaagagcttcaacagaggcgagtgctaagcggccgc

SEQ ID NO: 29 - protein, 219 aa, Artificial Sequence
  Amino acid sequence of the light chain of humanized anti-hTfR antibody No.3 containing amino acid sequence 6 as the variable region
DIVMTQTPLSLSVTPGQPASISCRSSQSLVHSNGNTYLHWYLQKPGQSPQLLIYKVSNRFSGVPDRFSGSGSGTDFTLKISRVEAEDVGVFFCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 30 - DNA, 740 bp, Artificial Sequence
  Nucleotide sequence encoding the amino acid sequence of the light chain of humanized anti-hTfR antibody No.3 containing amino acid sequence 6 as the variable region, synthetic sequence
acgcgtgccgccaccatgggctggagctggattctgctgttcctcctgagcgtgacagcaggagtgcacagcgacatcgtgatgacccagactcccctgagcctgagcgtgacacctggccagcctgccagcatcagctgcagatccagccagagcctggtgcacagcaacggcaacacctacctgcactggtatctgcagaagcccggccagagccctcagctgctgatctacaaggtgtccaacagattcagcggcgtgcccgacagattctccggcagcggctctggcaccgacttcaccctgaagatttccagagtggaagccgaggacgtgggcgtgttcttctgcagccagagcacccacgtgccctggacattcggccagggcaccaaggtggaaatcaagagaaccgtggccgctcccagcgtgttcatcttcccacctagcgacgagcagctgaagtccggcacagcctctgtcgtgtgcctgctgaacaacttctacccccgcgaggccaaggtgcagtggaaggtggacaacgccctgcagagcggcaacagccaggaaagcgtgaccgagcaggactccaaggacagcacctacagcctgagcagcaccctgaccctgagcaaggccgactacgagaagcacaaggtgtacgcctgcgaagtgacccaccagggcctgtctagccccgtgaccaagagcttcaacagaggcgagtgctaagcggccgc

SEQ ID NO: 31 - protein, 118 aa, Artificial Sequence
  Amino acid sequence 1 of the variable region of the heavy chain of humanized anti-hTfR antibody No.3
QVQLVQSGAEVKKPGASVKVSCKASGYTFTNYWLGWVRQAPGQGLEWMGDIYPGGDYPTYSEKFKVRVTMTRDTSTSTVYMELSSLRSEDTAVYYCARSGNYDEVAYWGQGTLVTVSS

SEQ ID NO: 32 - protein, 118 aa, Artificial Sequence
  Amino acid sequence 2 of the variable region of the heavy chain of humanized anti-hTfR antibody No.3
EVQLVQSGAEVKKPGESLKISCKGSGYSFTNYWLGWVRQMPGKGLEWMGDIYPGGDYPTYSEKFKVQVTISADKSISTAYLQWSSLKASDTAMYYCARSGNYDEVAYWGQGTLVTVSS

SEQ ID NO: 33 - protein, 118 aa, Artificial Sequence
  Amino acid sequence 3 of the variable region of the heavy chain of humanized anti-hTfR antibody No.3
QVQLVQSGAEVKKPGASVKVSCKASGYTFTNYWLGWVRQAPGQGLEWMGDIYPGGDYPTYSEKFKVRVTMTRDTSISTAYMELSRLRSDDTAVYYCARSGNYDEVAYWGQGTTVTVSS

SEQ ID NO: 34 - protein, 118 aa, Artificial Sequence
  Amino acid sequence 4 of the variable region of the heavy chain of humanized anti-hTfR antibody No.3
QVQLVQSGAEVKKPGASVKVSCKASGYTFTNYWLGWVRQAPGQRLEWMGDIYPGGDYPTYSEKFKVRVTITRDTSASTAYMELSSLRSEDTAVYYCARSGNYDEVAYWGQGTLVTVSS

SEQ ID NO: 35 - protein, 118 aa, Artificial Sequence
  Amino acid sequence 5 of the variable region of the heavy chain of humanized anti-hTfR antibody No.3
QVQLVQSGAEVKKPGSSVKVSCKASGGTFSNYWLGWVRQAPGQGLEWMGDIYPGGDYPTYSEKFKVRVTITADKSTSTAYMELSSLRSEDTAVYYCARSGNYDEVAYWGQGTVVTVSS

SEQ ID NO: 36 - protein, 118 aa, Artificial Sequence
  Amino acid sequence 6 of the variable region of the heavy chain of humanized anti-hTfR antibody No.3
EVQLVQSGAEVKKPGESLKISCKGSGYSFMNYWLGWVRQMPGKGLEWIGDIYPGGDYPTYSEKFKVKAIISADTSISTVYLQLSSLKASDTAMYFCARSGNYDEVAYWGQGTLVTVSS

SEQ ID NO: 37 - protein, 448 aa, Artificial Sequence
  Amino acid sequence of the heavy chain of humanized anti-hTfR antibody No.3 containing amino acid sequence 2 as the variable region
EVQLVQSGAEVKKPGESLKISCKGSGYSFTNYWLGWVRQMPGKGLEWMGDIYPGGDYPTYSEKFKVQVTISADKSISTAYLQWSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - DNA, 1427 bp, Artificial Sequence
  Nucleotide sequence encoding the amino acid sequence of the heavychain of humanized anti-hTfR antibody No.3 containing amino acid sequence 2 as the variable region, synthetic sequence
acgcgtgccgccaccatgggctggagctggattctgctgttcctcctgagcgtgacagcaggagtgcacagcgaggtgcaactagtgcagtctggagcagaggtgaaaaagcccggggagtctctgaagatttcctgtaagggttctggatacagctttaccaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagtggagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacgtgcccaccgtgcccagcacctgaactcctgggaggtccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataagcggccgc

SEQ ID NO: 39 - protein, 445 aa, Artificial Sequence
  Amino acid sequence of the heavy chain (IgG4) of humanized anti-hTfR antibody No.3 containing amino acid sequence 2 as the variable region
EVQLVQSGAEVKKPGESLKISCKGSGYSFTNYWLGWVRQMPGKGLEWMGDIYPGGDYPTYSEKFKVQVTISADKSISTAYLQWSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 40 - DNA, 1418 bp, Artificial Sequence
  Nucleotide sequence encoding the amino acid sequence of the heavy chain (IgG4) of humanized anti-hTfR antibody No.3 containing amino acid sequence 2 as the variable region, synthetic sequence
acgcgtgccgccaccatgggctggagctggattctgctgttcctcctgagcgtgacagcaggagtgcacagcgaggtgcaactagtgcagtctggagcagaggtgaaaaagcccggggagtctctgaagatttcctgtaagggttctggatacagctttaccaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagtggagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcctggggggtccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctccgggtaaataagcggccgc

SEQ ID NO: 41 - DNA, 43 bp, Artificial Sequence
  Primer hTfR5', synthetic sequence
ccgacgcgtcgccaccatgatggatcaagctagatcagcattc

SEQ ID NO: 42 - DNA, 59 bp, Artificial Sequence
  Primer hTfR3', synthetic sequence
ataatgcggccgcttaatgatgatgatgatgatgaaactcattgtcaatgtcccaaacg

SEQ ID NO: 43 - DNA, 20 bp, Artificial Sequence
  Primer Hyg-Sfi5', synthetic sequence
gaggccgcctcggcctctga

SEQ ID NO: 44 - DNA, 29 bp, Artificial Sequence
  Primer Hyg-BstX3', synthetic sequence
aaccatcgtgatgggtgctattcctttgc

SEQ ID NO: 45 - DNA, 4460 bp, Artificial Sequence
  "Nucleotide sequence of the DNA formed of a cDNA encoding chimeric hTfR and a loxP-flanked neomycin resistance gene placed on the cDNA's 3' side, synthetic sequence "
gtttatcctcccttgtagcagctgagaatgatggatcaagccagatcagcattctctaacttgtttggtggggaaccattgtcatacacccggtttagccttgctcggcaagtagatggagataacagtcatgtggagatgaaactggctgcagatgaagaagaaaatgccgacaataacatgaaggctagtgtcagaaaacccaagaggtttaatggaagactctgctttgcagctattgcactagtcattttcttcttgattggattcatgagtggctacctgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaacgtggctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgatcctctagttaagcttcccagcggccgctatcgaattccgatcatattcaataacccttaatataacttcgtataatgtatgctatacgaagttattaggtctgaagaggagtttacgtccagccaagctaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagccaatatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatccctcgatcgagatccggaacccttaatataacttcgtataatgtatgctatacgaagttattaggtccctcgaagaggttcactagttctagagcatttaaatacgtgctagc

SEQ ID NO: 46 - DNA, 5003 bp, Artificial Sequence
  Nucleotide sequence of the 5'-arm of targeting vector, synthetic sequence
aaagacattcccagggtccctaagggctccatctgggagcgcgctatctgtagtcctgttgtggtttaagataccactctctttgttatttgtaaatttaccacaggctgggcagtaaagtacagataggaagaaaagagtgtgaacgtttgcagttttaacagaactccttttatttgctatgcattgcaacaaccctctaaaagcaataatggcgataaacatgcaagttaatctacaactttatcaccctagtaaatcattggttcctatttcccttccataggctgaacatagtgagcactggtagctctttgcttggcttaagcgctgcttgttaaaatctaaaaaaaaaaaaaaaaaagatttgcagttttgctttaaagtttttcctttaaagcatctctgagctgcaaaaactcgtctttaggatatggttttggcggagacctaagcctgcaagtaggaatattttaaagagtaaaggctgatactttcgaacttgcaccgcagggttgggtgtcggtcaaggttaggcggagggcgacaggccaactccaaagacacggcgggggaggggtgcggtggagaaagcgagccgcagccaatcgcacgcgctctcccgacacctgccgccttggcgccttttctaggctactccgcgcacgcactggctgcgcgcgcagttcgcctccagcggtcttgggggagcacctcggtaggtgtacgtgcggaaggaagtgacgtagatccagagggccggccggggggtggggccgagctataagctttgggtgggaggcagcgctgccttcagaaggcgtgcggagcgcgggctgctgcattgcggactgtagaggcgcttcctagtgagtgactcccttgtcagcggcacggcccatcgtggtcctcgcgtggcgggcggaccagagcgagacgccagggcctgggtggtgcgggcggggaggcggaggggtgtcgcggagtccggggctgaggagcgcgggttgcaggtgcagcgcggtgggtgtggggagccgctgtaccctgcgcccctcgggtcctccgggccttcgcaggccagtgctaggccgcgggttcgagagtcaccacgctgaggcgcaggcttgttccgccgggagcacgtggtggcggctggaggaagtcgccccagggaacggctgtcggggtacgtgggtgaccttggggcccctcgcaggagggcgtcacagctgaaaaggacaaagctgttttctattcggttactagtgtcacggacatttagaggggcggggggagcttccaataactgcacgttggaacttcggcaccacctggtcggtttttttgccagtctctccctcttggcccagcgtgtggaatctcatttttctagggcagaataggtctgaacgctgcaggtaatactaagaacgtctctagcatctcctaagatgggagaacgtagaaatacgacctctttgtacgagctcttttagaactagctgtagagaaccagcgtgcaccctggtgttggacagctctctaaaatggtgtttgagggtaagaaaactgcatttgcaaatttttcagttagcacactttgtcccgagcgtaaaatgaaatgatctccttatacttaggcagaagactggactggattgctgttcagtttctgtgctatttttttaaaataggatttaagtgggaaatagttgtgttacagaaattctcggctattctgtgctatttttttttaaataggatttaagtgggaaatagttgtgttacagaaattctcggctacctgatacttttattctaagattagatgagttggctctgagctgtgaaatatgacctctttgacaaagacatttaagctgattcaggatgttatctacaaagaaaacgggatttagcttgtgtgggtccacttgcatttattttctgttaaggattataataaactgctttatacaggaatccaatatcagctgttttttatatagagagcataatactttttactttgagagaggatgttgtcaaggaatggtggctgtgaacctggcctgtgttgactggttagatctgtctgcctaaccccaccctaaggctaagtagttatatgcttgtggcaatgtgcttatttataatagggcaagattatgggctaaatttgggttagacaacaatgaaagttaattaaacgaccctcaggccttgggtctactatgtgtaagtgatttccttctctcccagatgagtgctatacaaaataaacttcagtgacctcaagtggttttgaccttttggttgctattcagaaaactatggaaatgaaaacctgctacctatttcctattgccttttcaatttcccaaagaaggtctcccctatgaatccatgggtagccttgaactcagatccacctgcttctgtttggagagtgataagattaaaggcaagtgccaccacacccagcaaagtaggctcttaaaactaaaacctttgcagtcgggcatggtgccacacacctttggtcccagcactggggggtaaggcagaggcaggtggatcactgagtttgaggtcagctagtgctgaagagtaagagcctgtctttaaaacatctcaacagctgggcagtcgtggtccattcctttaatcccagcacttgggaggcagaggcaagtggatttttgagttcgaggccagcctggtctacagagtgagttccaggacagccagggatacacagagaaaccctgtctcaaaaaaccaaaatataaataaataaataaagattgggagagaagtcaaggatctcataggtggtcagggagctacaactgcagtagtaaagaagtaggacttaaaagaacagggccggcactaattttgaggatctagatcgggccctcaattaaggaacttccttttgtgtgaactcagaatttgaaatgaaatgtgcttgtcagaaccattgcatggcttattttttaatgaaaagtctggctagtatctgcttatcttccagcttccagctcaaagttaaggtcatagatcaaaagaactatgtctttatcttagttgtatcttaatttttattagaattgaatggttttcctaatgtttggtaacatcaaaggtgtgtaagtaaaagtgagaaatcaagattaactttctcttggcaaagattgttgacattggtgacatcttggaccaaatgagaattgttttacttttaaatgtcccatcaacagctctcagttaggctgttctatctggtttgtcttgccatgcttgcagagtatagatttgacaatttgaaaattcaaaaagctatataaataggtatgttgctatatgtaagattttaaatgagtcagttaagacttaaagaataactgggtttattttatcttgtcaggttatcactgtgtagaccaggttgaccttgaaaacaaattctctgcttcccaagtgctgggattaaaggcgtgtgtcactagctctgacactggctactttggaactactatggtgttcacaaatgcagagttgagtgttgggattaaatggaaatttcatgtctttttttttaactttcccttctacacagggcttctctgtgtagtcctggctgtccttgtagctctagactaggctgaattcaaactcagatccacccacctaagtgctgagattaaaggcatgtgccaccactgcccagttctgaattgttggggttttttttttgttgttattcttaattttagttcgatgaattaaaatcgaaataacttgtttcttagaaaaataaggtgtaattgggttataaagccaaatttagacattaataccaacagcctgtttaggctcaaaattgttcaatcattttattagtattattattaatcatatcaacttgagacctgtttgggaaagcagaatattttagggatagctatttcagacaagcattaatgtgttagctgtttttttccccctagaatatgattaaaattggctcagggtggggccttctagttctggctctagcgattgggtctgtttctggtgaggtggtagtgataaactgtaacagaagggacaagagattgggcttctgagaacatgtatgatctggtatgtgactttaatcattaaagcatggggattcaaaaatactaatgaataggccttagaactagtcctgagtgttttgtaaaataacagtcttaattctcctagtttctggatttttttctttgtctttggatactaagtttaagcatttatttggacagagtggtgcccactagctgttctattctagtacttgggaggcaagaggcagaacgaacatggccagcttggacaacttaagaaaactgaaaggcttgccatcctagtttttcttttgattaaacacacttatattctaactagttttctctatcctttgggttttgttttgttttttatttgttttgtagctctagctggctggcttcggaattgcctgcctcccaagtgctaggattaaaggcatcacagtcactacccaattgatatcatgattcttaattcaacttctaagaacaaattatcacactctgaatctaacatggaatagcattatccatgttcagatatctttgtctcaaggctcaggtttatcctttgtagctttctttttgctatcccacctctattcagcatccagtcaaggatcactgagttggttatcagtaaattaaacattttaattaatgtctaggagacaggttatggtatagttctcagtgctgggaagttgacatggtaggatctcagttcatggccagccagaactttctggtgagatcctggttcaagcactacagagcttttctagaaaagtaactatatttaggagtaagtttgatataatgacaatcccatcgtaagccttcagtaacctgatgcattggtctctgttttaatatcaggta

SEQ ID NO: 47 - DNA, 2604 bp, Artificial Sequence
  Nucleotide sequence of the 3'-arm of targeting vector, synthetic sequence
gcattctctaacttggtaaggtactttcatctatctgaaaaaatgttcagtaaaaaacaaaacaaaaacatgacttcacccagtgagtacaagatgatacccccaattttttttttttttattatatgtatgtacactgtagctgtcttcagacacaccagaagagggcgtcagatctcatcagatggttgtgagccaccatgtggttgctgggacttgaacactggacctttggaaaagcagttgggtactcttacccactgagctatcacaccagccccaataccccaaattttgaccagccttttttttttttttttttttttttttaaatctgaactaatggtattaaggtgaaacagattgcacaaaagaggtactaggtttttctttgaggcaaggtctttctatattgcctcaggttgaccttaaactccaacttcctttttttccccaagtgctggagattgtagacagatatatacaacaccccaaaacaaatatgtttagtttcgattaagattcattatgtggggctagagggatgacttagaggttaagaacactgcctgctcttccagaggtcctgagttcaattcccagcaaccacgtggtggctcacaaccatctgtaatgggatccgatgccctctttctggtgtgtttgaagacagctacagtgtcctcatacataaaaaaaataaacaaacagatcttttaaaaaaaaaggtacagtgtacttatacattatataaatgaatgattctttaaaaaattaattatgggaaatacttatgaagaatagggtagctttggctgttttggaaacgttatataacaaggtagaactaaaatgtatgccagtaatcccagaggaatcattagccagtcagggctagtctgagcaatgtggcaagataaacccatctctttaaaaaaaaaaaaaagtattataaatagaaatgttataggaaacaggaaatagaaaccctcgaaaggctgaatgaaagagtattagtgggctggagagatggttcagcggttaagagcactatctcctgagttcagttcccagtgaccacatggtggctcacagccatctgtaatgagatctgacgccctcttctggggtgtctgaagacagcgacagtgtactcacataaaataaatacataaagactgttagttagccttcatctaccatttacagaactgggcacagaaaggagttcatcagttataaagggtaactttccatatgaatgtttgtcatattattatgcatatagtataatgaccaaactactgtaatgtcttaatatttgtatctcttttctcttttttaaaaatatcagtttggtggggaaccattgtcatacacccggtttagccttgctcggcaagtagatggagataacagtcatgtggagatgaaactggctgcagatgaagaagaaaatgccgacaataacatgaaggctagtgtcagaaaacccaagaggtttaatggaagactctgctttgcagctattgcactagtcattttcttcttgattggtaagaatgagtggccattcagaaggatttcttatgactaactagttcttagactagctagttcttagactagctagttcttgtttcttttggatgaggagatgctttgtactttaaatggcactggggctccctacctgccggcagattaggtcctgcaagatgggaaacgtttacattatggatgttttattagagatatgcaggacatttggaatagtactaagaaaggcttccagtaagacaaggtgtgcacccatgtcttaaacaggtcactgtaaaatatgacttagttgtggtaatttaaattccattaaactcaggttcataattttctattagattctcatagtttaattaaaagttttcagggataagttaaaaatgagttctgtgagtttagctctaaaacttcctgtttttaggattcatgagtggctacctgggctattgtaagcgtgtagaacaaaaagaggagtgtgtgaaactggctgaaacggaggagacagacaagtcagaaaccatggaaacagaggatgttcctacatcatctcgcttatattgggcagacctcaaaacactgttgtcagagaagttgaactccatagagtttgctgacaccatcaagtaagctcaacttcccaagttcagtcctgatggaaacgtttttgttgggggggtagggagacttgaaaggctttcagagggtcctcctgacaatgtggaactatgctgacaggaaattaggacttacctggagagcctcatagcctcctttttcttcagaatcgttttatcagttgtagtttagtgtgggatgtcagattttcttctgttctaatattccttttaaaaattttttaaaattaaaattactttttatgtattatgagtatagcctgcatatatgaatgaatgtgcattactaattacacttatctcctagtgcctacataagccttatagatggttgtgagccagcatgtgggtgctggaatccaaaatggttcttgcaagaccaaatatgttacatcccagagccattaca

SEQ ID NO: 48 - protein, 113 aa, Artificial Sequence
  Amino acid sequence of the variable region of the light chain of mouse anti-hTfR antibody No.3
DIVMTQTTLSLPVSLGDQASISCRSSQSLVHSNGNTYLHWYLQKPGQSPKLLIYKVSNRFSGVPDRFSGSGSGTDFTLKISRVEAEDLGVFFCSQSTHVPWTFGGGTKLEIKR

SEQ ID NO: 49 - protein, 118 aa, Artificial Sequence
  Amino acid sequence of the variable region of the heavy chain of mouse anti-hTfR antibody No.3
EVQLQESGAELVRPGTSVKISCKASGYSFTNYWLGWVKQRPGHGLEWIGDIYPGGDYPTYSEKFKVKAILTADTSSSSVYLHLSSLTSEDSAVYFCARSGNYDEVAYWGQGTLVTVST

SEQ ID NO: 50 - protein, 525 aa, Homo sapiens
SETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 51 - protein, 975 aa, Artificial Sequence
  Amino acid sequence of fusion protein of the heavy chain of anti-hTfR antibody No.3 (humanized 2) and hI2S
EVQLVQSGAEVKKPGESLKISCKGSGYSFTNYWLGWVRQMPGKGLEWMGDIYPGGDYPTYSEKFKVQVTISADKSISTAYLQWSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 52 - DNA, 3011 bp, Artificial Sequence
  Nucleotide sequence encoding the amino acid sequence of fusion protein of the heavy chain of anti-hTfR antibody No.3 (humanized 2) and hI2S, synthetic sequence
acgcgtgccgccaccatgggctggagctggattctgctgttcctcctgagcgtgacagcaggagtgcacagcgaggtgcaactagtgcagtctggagcagaggtgaaaaagcccggggagtctctgaagatttcctgtaagggttctggatacagctttaccaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagtggagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacgtgcccaccgtgcccagcacctgaactcctgggaggtccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggatcttccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaagatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagaccttttccagttgttgatgccttaataagcggccgc

SEQ ID NO: 53 - protein, 975 aa, Artificial Sequence
  Amino acid sequence of fusion protein of the heavy chain of humanized anti-hTfR antibody No.3N and hI2S
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 54 - DNA, 3011 bp, Artificial Sequence
  Nucleotide sequence encoding the amino acid sequence of fusion protein of the heavy chain of humanized anti-hTfR antibody No.3N and hI2S, synthetic sequence
acgcgtgccgccaccatgggctggagctggattctgctgttcctcctgagcgtgacagcaggagtgcacagcgaggtgcaactagtgcagtctggagcagaggtgaaaaagcccggggagtctctgaagatttcctgtaagggttctggatacagctttatgaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagttgagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacgtgcccaccgtgcccagcacctgaactcctgggaggtccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggatcttccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaagatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagaccttttccagttgttgatgccttaataagcggccgc

SEQ ID NO: 55 - protein, 883 aa, Homo sapiens
AHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 56 - protein, 896 aa, Homo sapiens
QQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 57 - protein, 1333 aa, Artificial Sequence
  Amino acid sequence of fusion protein of the heavy chain of humanized anti-hTfR antibody No. 3N and hGAA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 58 - protein, 1330 aa, Artificial Sequence
  Amino acid sequence of fusion protein of the heavy chain of humanized anti-hTfR antibody No. 3N (IgG4) and hGAA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 59 - DNA, 4076 bp, Artificial Sequence
  Nucleotide seuquence encoding the amino acid sequence of fusion protein of the heavy chain of humanized anti-hTfR antibody No. 3N (IgG4) and hGAA, synthetic sequence
acgcgtgccgccaccatgggttggagcctcatcttgctcttccttgtcgctgttgctacgcgagtcggcagcgaggtgcaactagtgcagtctggagcagaggtgaaaaagcccggggagtctctgaagatttcctgtaagggttctggatacagctttatgaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagttgagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcctggggggtccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctccgggtaaaggatctgctcaccctggacggcctagggccgtgcctacccagtgcgacgtgcctcctaattccaggttcgactgcgcccccgataaagccatcacccaggaacagtgtgaggccaggggctgttgctatattcccgccaagcagggcctgcagggcgctcagatgggccagccctggtgcttcttccccccctcctatccctcctacaagctggaaaacctgtcctcctccgagatgggctacacagccaccctcacaaggacaacccccaccttcttccccaaggacatcctcaccctgcggctggatgtgatgatggagaccgagaaccggctgcacttcaccatcaaggaccctgccaatcggcggtacgaggtgcctctggaaaccccccgggtgcactccagggctccttcccctctgtatagcgtggagtttagcgaggagcccttcggcgtgatcgtgcaccggcagctcgacggaagggtgctgctgaacaccaccgtcgcccccctgttcttcgccgatcagttcctccagctgtccacctccctgccctcccagtacattaccggcctggctgagcacctgagccccctgatgctgtccaccagctggacaaggatcaccctgtggaatcgggacctcgctcccacccctggagccaatctgtacggcagccaccccttctacctggccctcgaagatggaggcagcgctcatggcgtgttcctgctgaattccaacgctatggacgtggtgctccaaccctcccctgccctgtcctggaggagcacaggcggcattctggacgtctacattttcctcggccccgagcctaaatccgtcgtccagcagtacctggacgtggtgggctacccttttatgcctccttactggggcctgggctttcacctgtgtaggtggggctattccagcaccgctattacacggcaggtcgtcgaaaacatgacacgggcccactttcccctggacgtccaatggaatgacctggactacatggactcccggcgggacttcacattcaataaggacggcttccgggacttccctgccatggtgcaggagctgcatcagggaggccggaggtacatgatgattgtggaccctgctatttccagctccggacctgctggctcctaccggccctacgacgagggactgcggaggggcgtcttcatcacaaacgaaaccggtcagcccctgattggaaaggtgtggcccggttctacagctttccccgactttacaaaccccacagccctggcttggtgggaggacatggtggccgagtttcacgaccaggtgcctttcgacggcatgtggatcgatatgaacgagccttccaactttatcaggggcagcgaggatggctgccccaacaacgagctcgagaatcccccctacgtccccggagtcgtgggaggcacactccaggctgccacaatctgcgccagctcccatcagttcctgagcacccattacaacctgcataacctgtacggcctcaccgaagccatcgccagccatagggctctggtgaaggccaggggaacacggcctttcgtgatctccaggagcacatttgccggccacggcaggtacgctggccactggacaggcgatgtctggtcctcctgggagcaactggcttccagcgtccccgagatcctccagttcaacctgctgggcgtgcccctggtgggcgccgacgtgtgcggctttctcggcaacacctccgaggagctgtgtgtgcggtggacccagctgggcgccttctatccctttatgcggaatcacaacagcctgctgtccctgcctcaggaaccctacagcttcagcgaacctgctcagcaggccatgcggaaggccctgaccctccggtatgccctgctgccccacctctataccctgtttcatcaggctcatgtggctggcgagacagtggctaggcctctgttcctggagtttcccaaggattccagcacatggacagtggaccatcagctgctgtggggcgaggctctgctgatcacacccgtgctgcaggccggcaaagccgaggtgacaggctatttccccctgggaacctggtacgacctccagacagtgcccattgaggccctgggttctctccctcctcctcctgccgctcccagggaacctgctatccactccgaaggccagtgggtgaccctgcctgctcccctggacacaatcaacgtccacctgcgggctggctacattattcctctccagggacccggcctgacaaccacagagagcaggcagcagcccatggccctggctgtcgctctgacaaaaggaggcgaggcccggggagagctcttctgggatgacggcgagagcctggaggtcctggagaggggagcctatacccaggtgatcttcctcgcccggaacaacaccattgtgaacgagctggtgagggtcacatccgaaggagccggactgcaactgcagaaagtgacagtgctgggcgtcgccaccgctcctcaacaggtgctgtccaacggcgtgcccgtctccaactttacctacagccccgacaccaaggtgctggacatttgtgtgtccctgctgatgggcgaacagtttctggtgtcctggtgttaataagcggccgc

SEQ ID NO: 60 - protein, 245 aa, Artificial Sequence
  Amino acid sequence of single-chain humanized anti-hTfR antibody No. 3N
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSGGGGSGGGGSGGGGSDIVMTQTPLSLSVTPGQPASISCRSSQSLVHSNGNTYLHWYLQKPGQSPQLLIYKVSNRFSGVPDRFSGSGSGTDFTLKISRVEAEDVGVYYCSQSTHVPWTFGQGTKVEIK

SEQ ID NO: 61 - protein, 226 aa, Artificial Sequence
  Amino acid sequence of Fab heavy chain of  humanized anti-hTfR antibody No. 3N
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 62 - protein, 8 aa, Artificial Sequence
  Amino acid sequence 1 of CDR1 in the heavy chain of humanized anti-hTfR antibody No. 3N
GYSFMNYW

SEQ ID NO: 63 - protein, 10 aa, Artificial Sequence
  Amino acid sequence 2 of CDR1 in the heavy chain of humanized anti-hTfR antibody No. 3N
GYSFMNYWLG

SEQ ID NO: 64 - protein, 30 aa, Artificial Sequence
  Amino acid sequence of framework region 3 in the heavy chain of humanized anti-hTfR antibody No. 3N
QVTISADKSISTAYLQLSSLKASDTAMYYC

SEQ ID NO: 65 - protein, 118 aa, Artificial Sequence
  Amino acid sequence of the variable region of the heavy chain of humanized anti-hTfR antibody No. 3N
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSS

SEQ ID NO: 66 - protein, 448 aa, Artificial Sequence
  Amino acid sequence of the heavy chain of humanized anti-hTfR antibody No. 3N
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - DNA, 1427 bp, Artificial Sequence
  Nucleotide seuquence encoding the amino acid sequence of the heavy chain of humanized anti-hTfR antibody No. 3N, synthetic sequence
acgcgtgccgccaccatgggctggagctggattctgctgttcctcctgagcgtgacagcaggagtgcacagcgaggtgcaactagtgcagtctggagcagaggtgaaaaagcccggggagtctctgaagatttcctgtaagggttctggatacagctttatgaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagttgagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacgtgcccaccgtgcccagcacctgaactcctgggaggtccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataagcggccgc

SEQ ID NO: 68 - protein, 445 aa, Artificial Sequence
  Amino acid sequence of the heavy chain of humanized anti-hTfR antibody No. 3N (IgG4)
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 69 - DNA, 1418 bp, Artificial Sequence
  Nucleotide seuquence encoding the amino acid sequence of the heavy chain of humanized anti-hTfR antibody No. 3N (IgG4), synthetic sequence
acgcgtgccgccaccatgggctggagctggattctgctgttcctcctgagcgtgacagcaggagtgcacagcgaggtgcaactagtgcagtctggagcagaggtgaaaaagcccggggagtctctgaagatttcctgtaagggttctggatacagctttatgaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagttgagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcacctgagttcctggggggtccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctccgggtaaataagcggccgc

SEQ ID NO: 70 - protein, 218 aa, Homo sapiens
PAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 469 aa, Artificial Sequence
  Amino acid sequence of the Fab heavy chain of humanized anti-hTfR antibody 3N, further introduced with Fc region of human IgG
PAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 72 - DNA, 1491 bp, Artificial Sequence
  Nucleotide seuquence encoding the amino acid sequence of the Fab heavy chain of humanized anti-hTfR antibody 3N, further introduced with Fc region of human IgG
acgcgtcgccaccatgggttggagcctcatcttgctcttccttgtcgctgttgctacgcgagtcggcagcccagcacctgaactcctgggaggtccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggtggcggagggtctggaggaggcggtagcggcggaggaggttccgggggcggtggaagcggaggcggtggatccgaggtgcaactagtgcagtctggagcagaggtgaaaaagcccggggagtctctgaagatttcctgtaagggttctggatacagctttatgaactactggctgggatgggtgcgccagatgcccgggaaaggcctggagtggatgggggacatctaccccggcggagactaccctacatacagcgagaagttcaaggtccaggtcaccatctcagccgacaagtccatcagcaccgcctacctgcagttgagcagcctgaaggcctcggacaccgccatgtattactgtgcgagatcaggcaattacgacgaagtggcctactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagccgaagagctgtgataagacgcatacgtaataagcggccgc

SEQ ID NO: 73 - protein, 30 aa, Artificial Sequence
  Amino acid sequence of framework region 3 in the heavy chain of humanized anti-hTfR antibody No. 3
QVTISADKSISTAYLQWSSLKASDTAMYYC

SEQ ID NO: 74 - protein, 46 aa, Artificial Sequence
  Amino acid sequence of albumin binding domain
LAEAKVLALRELDKYGVSDYYKDLIDKAKTVEGVKALIDEILAALP

SEQ ID NO: 75 - protein, 628 aa, Homo sapiens
AEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 76 - protein, 626 aa, Homo sapiens
APHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 77 - protein, 279 aa, Homo sapiens
DPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 78 - protein, 583 aa, Homo sapiens
LSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 79 - protein, 489 aa, Homo sapiens
RPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 80 - protein, 482 aa, Homo sapiens
RPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 81 - protein, 497 aa, Homo sapiens
ARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 82 - protein, 544 aa, Homo sapiens
SYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHHFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 83 - protein, 720 aa, Homo sapiens
DEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 84 - protein, 629 aa, Homo sapiens
LQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 85 - protein, 643 aa, Homo sapiens
YVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 86 - protein, 374 aa, Homo sapiens
QHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 87 - protein, 435 aa, Homo sapiens
QPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 88 - protein, 962 aa, Homo sapiens
GGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 89 - protein, 1124 aa, Artificial Sequence
  Amino acid sequence of fusion protein of the Fab heavy chain of humanized anti-hTfR antibody No. 3N and hGAA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPRVHSRAPSPLYSVEFSEEPFGVIVHRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPIEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 90 - protein, 1075 aa, Artificial Sequence
  Amino acid sequence of fusion protein of the heavy chain of humanized anti-hTfR antibody No. 3N (IgG4) and hIDUA, IgG4 HC-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 91 - protein, 1113 aa, Artificial Sequence
  Amino acid sequence of fusion protein of the heavy chain of humanized anti-hTfR antibody No. 3N (IgG4) and hIDUA, IgG4 HC-GS8-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSGGGGSGGGGSGGGGSGGGGSGGGGSGGGGSGGGGSGGGGSAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 92 - protein, 1173 aa, Artificial Sequence
  Amino acid sequence of fusion protein of the heavy chain of humanized anti-hTfR antibody No. 3N (IgG4) and hIDUA, IgG4 HC-GS20-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 93 - protein, 869 aa, Artificial Sequence
  Amino acid sequence of fusion protein of the Fab heavy chain of humanized anti-hTfR antibody No. 3N and hIDUA, Fab HC-GS3-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 94 - protein, 879 aa, Artificial Sequence
  Amino acid sequence of fusion protein of the Fab heavy chain of humanized anti-hTfR antibody No. 3N and hIDUA, Fab HC-GS5-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 95 - protein, 904 aa, Artificial Sequence
  Amino acid sequence of fusion protein of the Fab heavy chain of humanized anti-hTfR antibody No. 3N and hIDUA, Fab HC-GS10-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 96 - protein, 954 aa, Artificial Sequence
  Amino acid sequence of fusion protein of the Fab heavy chain of humanized anti-hTfR antibody No. 3N and hIDUA, Fab HC-GS20-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 97 - protein, 1140 aa, Artificial Sequence
  Amino acid sequence of fusion protein of the Fab heavy chain of humanized anti-hTfR antibody No. 3N and hIDUA, Tandem Fab HC-IDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 98 - protein, 477 aa, Artificial Sequence
  Amino acid sequence of single-chain humanized anti-hTfR antibody No. 3N (2)
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGDIVMTQTPLSLSVTPGQPASISCRSSQSLVHSNGNTYLHWYLQKPGQSPQLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 1112 aa, Artificial Sequence
  Amino acid sequence of fusion protein of single-chain humanized anti-hTfR antibody No. 3N and hIDUA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGDIVMTQTPLSLSVTPGQPASISCRSSQSLVHSNGNTYLHWYLQKPGQSPQLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGSAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 100 - protein, 726 aa, Artificial Sequence
  Amino acid sequence of fusion protein of the heavy chain of humanized anti-hTfR antibody No. 3N (IgG4) and hPPT-1, IgG4 HC-PPT1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 101 - protein, 749 aa, Artificial Sequence
  Amino acid sequence of fusion protein of the heavy chain of humanized anti-hTfR antibody No. 3N (IgG4) and hPPT-1, IgG4 HC-GS5-PPT1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 102 - protein, 774 aa, Artificial Sequence
  Amino acid sequence of fusion protein of the heavy chain of humanized anti-hTfR antibody No. 3N (IgG4) and hPPT-1, IgG4 HC-GS10-PPT1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 103 - protein, 824 aa, Artificial Sequence
  Amino acid sequence of fusion protein of the heavy chain of humanized anti-hTfR antibody No. 3N (IgG4) and hPPT-1, IgG4 HC-GS20-PPT1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 104 - protein, 520 aa, Artificial Sequence
  Amino acid sequence of fusion protein of the Fab heavy chain of humanized anti-hTfR antibody No. 3N and hPPT-1, Fab HC-GS3-PPT1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 105 - protein, 791 aa, Artificial Sequence
  Amino acid sequence of fusion protein of the Fab heavy chain of humanized anti-hTfR antibody No. 3N and hPPT-1, Tandem Fab HC-PPT1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 106 - protein, 1030 aa, Artificial Sequence
  Amino acid sequence of fusion protein of the heavy chain of humanized anti-hTfR antibody No. 3N (IgG4) and hASM, IgG4 HC-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 107 - protein, 1053 aa, Artificial Sequence
  Amino acid sequence of fusion protein of the heavy chain of humanized anti-hTfR antibody No. 3N (IgG4) and hASM, IgG4 HC-GS5-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 108 - protein, 1078 aa, Artificial Sequence
  Amino acid sequence of fusion protein of the heavy chain of humanized anti-hTfR antibody No. 3N (IgG4) and hASM, IgG4 HC-GS10-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 109 - protein, 1128 aa, Artificial Sequence
  Amino acid sequence of fusion protein of the heavy chain of humanized anti-hTfR antibody No. 3N (IgG4) and hASM, IgG4 HC-GS20-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 110 - protein, 824 aa, Artificial Sequence
  Amino acid sequence of fusion protein of the Fab heavy chain of humanized anti-hTfR antibody No. 3N and hASM, Fab HC-GS3-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 111 - protein, 834 aa, Artificial Sequence
  Amino acid sequence of fusion protein of the Fab heavy chain of humanized anti-hTfR antibody No. 3N and hASM, Fab HC-GS5-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 112 - protein, 859 aa, Artificial Sequence
  Amino acid sequence of fusion protein of the Fab heavy chain of humanized anti-hTfR antibody No. 3N and hASM, Fab HC-GS10-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 113 - protein, 909 aa, Artificial Sequence
  Amino acid sequence of fusion protein of the Fab heavy chain of humanized anti-hTfR antibody No. 3N and hASM, Fab HC-GS20-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 114 - protein, 1095 aa, Artificial Sequence
  Amino acid sequence of fusion protein of the Fab heavy chain of humanized anti-hTfR antibody No. 3N and hASM, Tandem Fab HC-ASM
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSLSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 115 - protein, 936 aa, Artificial Sequence
  Amino acid sequence of fusion protein of the heavy chain of humanized anti-hTfR antibody No. 3N (IgG4) and hARSA, IgG4 IgG4 HC-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 116 - protein, 959 aa, Artificial Sequence
  Amino acid sequence of fusion protein of the heavy chain of humanized anti-hTfR antibody No. 3N (IgG4) and hARSA, IgG4 HC-GS5-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 117 - protein, 984 aa, Artificial Sequence
  Amino acid sequence of fusion protein of the heavy chain of humanized anti-hTfR antibody No. 3N (IgG4) and hARSA, IgG4 HC-GS10-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 118 - protein, 1034 aa, Artificial Sequence
  Amino acid sequence of fusion protein of the heavy chain of humanized anti-hTfR antibody No. 3N (IgG4) and hARSA, IgG4 HC-GS20-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 119 - protein, 730 aa, Artificial Sequence
  Amino acid sequence of fusion protein of the Fab heavy chain of humanized anti-hTfR antibody No. 3N and hARSA, Fab HC-GS3-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 120 - protein, 740 aa, Artificial Sequence
  Amino acid sequence of fusion protein of the Fab heavy chain of humanized anti-hTfR antibody No. 3N and hARSA, Fab HC-GS5-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 121 - protein, 765 aa, Artificial Sequence
  Amino acid sequence of fusion protein of the Fab heavy chain of humanized anti-hTfR antibody No. 3N and hARSA, Fab HC-GS10-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 122 - protein, 815 aa, Artificial Sequence
  Amino acid sequence of fusion protein of the Fab heavy chain of humanized anti-hTfR antibody No. 3N and hARSA, Fab HC-GS20-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 123 - protein, 1001 aa, Artificial Sequence
  Amino acid sequence of fusion protein of the Fab heavy chain of humanized anti-hTfR antibody No. 3N and hARSA, Tandem Fab HC-ARSA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSRPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 124 - protein, 929 aa, Artificial Sequence
  Amino acid sequence of fusion protein of the heavy chain of humanized anti-hTfR antibody No. 3N (IgG4) and hSGSH IgG4, IgG4 HC-SGSH
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSRPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 125 - protein, 952 aa, Artificial Sequence
  Amino acid sequence of fusion protein of the heavy chain of humanized anti-hTfR antibody No. 3N (IgG4) and hSGSH IgG4, IgG4 HC-GS5-SGSH
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSRPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 126 - protein, 977 aa, Artificial Sequence
  Amino acid sequence of fusion protein of the heavy chain of humanized anti-hTfR antibody No. 3N (IgG4) and hSGSH, IgG4 HC-GS10-SGSH
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSRPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 127 - protein, 1027 aa, Artificial Sequence
  Amino acid sequence of fusion protein of the heavy chain of humanized anti-hTfR antibody No. 3N (IgG4) and hSGSH, IgG4 HC-GS20-SGSH
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSRPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 128 - protein, 723 aa, Artificial Sequence
  Amino acid sequence of fusion protein of the Fab heavy chain of humanized anti-hTfR antibody No. 3N and hSGSH, Fab HC-GS3-SGSH
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSRPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 129 - protein, 994 aa, Artificial Sequence
  Amino acid sequence of fusion protein of the Fab heavy chain of humanized anti-hTfR antibody No. 3N and hSGSH, Tandem Fab HC-SGSH
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSRPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 130 - protein, 944 aa, Artificial Sequence
  Amino acid sequence of fusion protein of the heavy chain of humanized anti-hTfR antibody No. 3N (IgG4) and hGBA, IgG4 HC-GBA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 131 - protein, 967 aa, Artificial Sequence
  Amino acid sequence of fusion protein of the heavy chain of humanized anti-hTfR antibody No. 3N (IgG4) and hGBA, IgG4 HC-GS5-GBA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 132 - protein, 992 aa, Artificial Sequence
  Amino acid sequence of fusion protein of the heavy chain of humanized anti-hTfR antibody No. 3N (IgG4) and hGBA, IgG4 HC-GS10-GBA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 133 - protein, 1042 aa, Artificial Sequence
  Amino acid sequence of fusion protein of the heavy chain of humanized anti-hTfR antibody No. 3N (IgG4) and hGBA, IgG4 HC-GS20-GBA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 134 - protein, 738 aa, Artificial Sequence
  Amino acid sequence of fusion protein of the Fab heavy chain of humanized anti-hTfR antibody No. 3N and hGBA, Fab HC-GS3-GBA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 135 - protein, 1009 aa, Artificial Sequence
  Amino acid sequence of fusion protein of the Fab heavy chain of humanized anti-hTfR antibody No. 3N and hGBA, Tandem Fab HC-GBA
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 136 - protein, 991 aa, Artificial Sequence
  Amino acid sequence of fusion protein of the heavy chain of humanized anti-hTfR antibody No. 3N (IgG4) and hTPP-1, IgG4 HC-TPP1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHHFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 137 - protein, 1014 aa, Artificial Sequence
  Amino acid sequence of fusion protein of the heavy chain of humanized anti-hTfR antibody No. 3N (IgG4) and hTPP-1, IgG4 GS5-TPP1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHHFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 138 - protein, 1039 aa, Artificial Sequence
  Amino acid sequence of fusion protein of the heavy chain of humanized anti-hTfR antibody No. 3N (IgG4) and hTPP-1, IgG4 GS10-TPP1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHHFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 139 - protein, 1089 aa, Artificial Sequence
  Amino acid sequence of fusion protein of the heavy chain of humanized anti-hTfR antibody No. 3N (IgG4) and hTPP-1, IgG4 GS20-TPP1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHHFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 140 - protein, 785 aa, Artificial Sequence
  Amino acid sequence of fusion protein of the Fab heavy chain of humanized anti-hTfR antibody No. 3N and hTPP-1, Fab HC-GS3-TPP1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHHFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 141 - protein, 1056 aa, Artificial Sequence
  Amino acid sequence of fusion protein of the Fab heavy chain of humanized anti-hTfR antibody No. 3N and hTPP-1, Tandem Fab HC-TPP1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSEVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHHFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 142 - protein, 1167 aa, Artificial Sequence
  Amino acid sequence of fusion protein of the heavy chain of humanized anti-hTfR antibody No. 3N (IgG4) and hNAGLU, IgG4 HC-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 143 - protein, 1190 aa, Artificial Sequence
  Amino acid sequence of fusion protein of the heavy chain of humanized anti-hTfR antibody No. 3N (IgG4) and hNAGLU, IgG4 HC-GS5-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 144 - protein, 1215 aa, Artificial Sequence
  Amino acid sequence of fusion protein of the heavy chain of humanized anti-hTfR antibody No. 3N (IgG4) and hNAGLU, IgG4 HC-GS10-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 145 - protein, 1265 aa, Artificial Sequence
  Amino acid sequence of fusion protein of the heavy chain of humanized anti-hTfR antibody No. 3N (IgG4) and hNAGLU, IgG4 HC-GS20-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 146 - protein, 961 aa, Artificial Sequence
  Amino acid sequence of fusion protein of the Fab heavy chain of humanized anti-hTfR antibody No. 3N and hNAGLU, Fab HC-GS3-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 147 - protein, 971 aa, Artificial Sequence
  Amino acid sequence of fusion protein of the Fab heavy chain of humanized anti-hTfR antibody No. 3N and hNAGLU, Fab HC-GS5-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 148 - protein, 996 aa, Artificial Sequence
  Amino acid sequence of fusion protein of the Fab heavy chain of humanized anti-hTfR antibody No. 3N and hNAGLU, Fab HC-GS10-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 149 - protein, 1046 aa, Artificial Sequence
  Amino acid sequence of fusion protein of the Fab heavy chain of humanized anti-hTfR antibody No. 3N and hNAGLU, Fab HC-GS20-NAGLU
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 150 - protein, 1076 aa, Artificial Sequence
  Amino acid sequence of fusion protein of the heavy chain of humanized anti-hTfR antibody No. 3N (IgG4) and hGUSB, IgG4 HC-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 151 - protein, 1099 aa, Artificial Sequence
  Amino acid sequence of fusion protein of the heavy chain of humanized anti-hTfR antibody No. 3N (IgG4) and hGUSB, IgG4 HC-GS5-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 152 - protein, 1124 aa, Artificial Sequence
  Amino acid sequence of fusion protein of the heavy chain of humanized anti-hTfR antibody No. 3N (IgG4) and hGUSB, IgG4 HC-GS10-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 153 - protein, 1174 aa, Artificial Sequence
  Amino acid sequence of fusion protein of the heavy chain of humanized anti-hTfR antibody No. 3N (IgG4) and hGUSB, IgG4 HC-GS20-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 154 - protein, 870 aa, Artificial Sequence
  Amino acid sequence of fusion protein of the Fab heavy chain of humanized anti-hTfR antibody No. 3N and hGUSB, Fab HC-GS3-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 155 - protein, 880 aa, Artificial Sequence
  Amino acid sequence of fusion protein of the Fab heavy chain of humanized anti-hTfR antibody No. 3N and hGUSB, Fab HC-GS5-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 156 - protein, 905 aa, Artificial Sequence
  Amino acid sequence of fusion protein of the Fab heavy chain of humanized anti-hTfR antibody No. 3N and hGUSB, Fab HC-GS10-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 157 - protein, 955 aa, Artificial Sequence
  Amino acid sequence of fusion protein of the Fab heavy chain of humanized anti-hTfR antibody No. 3N and hGUSB, Fab HC-GS20-GUSB
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 158 - protein, 1090 aa, Artificial Sequence
  Amino acid sequence of fusion protein of the heavy chain of humanized anti-hTfR antibody No. 3N (IgG4) and hGALC, IgG4 HC-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 159 - protein, 1113 aa, Artificial Sequence
  Amino acid sequence of fusion protein of the heavy chain of humanized anti-hTfR antibody No. 3N (IgG4) and hGALC, IgG4 HC-GS5-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 160 - protein, 1138 aa, Artificial Sequence
  Amino acid sequence of fusion protein of the heavy chain of humanized anti-hTfR antibody No. 3N (IgG4) and hGALC, IgG4 HC-GS10-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 161 - protein, 1188 aa, Artificial Sequence
  Amino acid sequence of fusion protein of the heavy chain of humanized anti-hTfR antibody No. 3N (IgG4) and hGALC, IgG4 HC-GS20-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 162 - protein, 884 aa, Artificial Sequence
  Amino acid sequence of fusion protein of the Fab heavy chain of humanized anti-hTfR antibody No. 3N and hGALC, Fab HC-GS3-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 163 - protein, 894 aa, Artificial Sequence
  Amino acid sequence of fusion protein of the Fab heavy chain of humanized anti-hTfR antibody No. 3N and hGALC, Fab HC-GS5-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 164 - protein, 919 aa, Artificial Sequence
  Amino acid sequence of fusion protein of the Fab heavy chain of humanized anti-hTfR antibody No. 3N and hGALC, Fab HC-GS10-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 165 - protein, 969 aa, Artificial Sequence
  Amino acid sequence of fusion protein of the Fab heavy chain of humanized anti-hTfR antibody No. 3N and hGALC, Fab HC-GS20-GALC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 166 - protein, 821 aa, Artificial Sequence
  Amino acid sequence of fusion protein of the heavy chain of humanized anti-hTfR antibody No. 3N (IgG4) and hAC, IgG4 HC-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 167 - protein, 844 aa, Artificial Sequence
  Amino acid sequence of fusion protein of the heavy chain of humanized anti-hTfR antibody No. 3N (IgG4) and hAC, IgG4 HC-GS5-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 168 - protein, 869 aa, Artificial Sequence
  Amino acid sequence of fusion protein of the heavy chain of humanized anti-hTfR antibody No. 3N (IgG4) and hAC, IgG4 HC-GS10-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 169 - protein, 919 aa, Artificial Sequence
  Amino acid sequence of fusion protein of the heavy chain of humanized anti-hTfR antibody No. 3N (IgG4) and hAC, IgG4 HC-GS20-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 170 - protein, 615 aa, Artificial Sequence
  Amino acid sequence of fusion protein of the Fab heavy chain of humanized anti-hTfR antibody No. 3N and hAC, Fab HC-GS3-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 171 - protein, 625 aa, Artificial Sequence
  Amino acid sequence of fusion protein of the Fab heavy chain of humanized anti-hTfR antibody No. 3N and hAC, Fab HC-GS5-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 172 - protein, 650 aa, Artificial Sequence
  Amino acid sequence of fusion protein of the Fab heavy chain of humanized anti-hTfR antibody No. 3N and hAC, Fab HC-GS10-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 173 - protein, 700 aa, Artificial Sequence
  Amino acid sequence of fusion protein of the Fab heavy chain of humanized anti-hTfR antibody No. 3N and hAC, Fab HC-GS20-AC
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 174 - protein, 882 aa, Artificial Sequence
  Amino FUCA1id sequence of fusion protein of the heavy chain of humanized anti-hTfR antibody No. 3N (IgG4) and hFUCA1, IgG4 HC-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 175 - protein, 905 aa, Artificial Sequence
  Amino FUCA1id sequence of fusion protein of the heavy chain of humanized anti-hTfR antibody No. 3N (IgG4) and hFUCA1, IgG4 HC-GS5-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 176 - protein, 930 aa, Artificial Sequence
  Amino FUCA1id sequence of fusion protein of the heavy chain of humanized anti-hTfR antibody No. 3N (IgG4) and hFUCA1, IgG4 HC-GS10-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 177 - protein, 980 aa, Artificial Sequence
  Amino FUCA1id sequence of fusion protein of the heavy chain of humanized anti-hTfR antibody No. 3N (IgG4) and hFUCA1, IgG4 HC-GS20-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 178 - protein, 676 aa, Artificial Sequence
  Amino FUCA1id sequence of fusion protein of the Fab heavy chain of humanized anti-hTfR antibody No. 3N and hFUCA1, Fab HC-GS3-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 179 - protein, 686 aa, Artificial Sequence
  Amino FUCA1id sequence of fusion protein of the Fab heavy chain of humanized anti-hTfR antibody No. 3N and hFUCA1, Fab HC-GS5-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 180 - protein, 711 aa, Artificial Sequence
  Amino FUCA1id sequence of fusion protein of the Fab heavy chain of humanized anti-hTfR antibody No. 3N and hFUCA1, Fab HC-GS10-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 181 - protein, 761 aa, Artificial Sequence
  Amino FUCA1id sequence of fusion protein of the Fab heavy chain of humanized anti-hTfR antibody No. 3N and hFUCA1, Fab HC-GS20-FUCA1
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 182 - protein, 1409 aa, Artificial Sequence
  Amino LAMANid sequence of fusion protein of the heavy chain of humanized anti-hTfR antibody No. 3N (IgG4) and hLAMAN, IgG4 HC-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 183 - protein, 1432 aa, Artificial Sequence
  Amino LAMANid sequence of fusion protein of the heavy chain of humanized anti-hTfR antibody No. 3N (IgG4) and hLAMAN, IgG4 HC-GS5-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 184 - protein, 1457 aa, Artificial Sequence
  Amino LAMANid sequence of fusion protein of the heavy chain of humanized anti-hTfR antibody No. 3N (IgG4) and hLAMAN, IgG4 HC-GS10-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 185 - protein, 1507 aa, Artificial Sequence
  Amino LAMANid sequence of fusion protein of the heavy chain of humanized anti-hTfR antibody No. 3N (IgG4) and hLAMAN, IgG4 HC-GS20-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGKGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 186 - protein, 1203 aa, Artificial Sequence
  Amino LAMANid sequence of fusion protein of the Fab heavy chain of humanized anti-hTfR antibody No. 3N and hLAMAN, Fab HC-GS3-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 187 - protein, 1213 aa, Artificial Sequence
  Amino LAMANid sequence of fusion protein of the Fab heavy chain of humanized anti-hTfR antibody No. 3N and hLAMAN, Fab HC-GS5-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 188 - protein, 1238 aa, Artificial Sequence
  Amino LAMANid sequence of fusion protein of the Fab heavy chain of humanized anti-hTfR antibody No. 3N and hLAMAN, Fab HC-GS10-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 189 - protein, 1288 aa, Artificial Sequence
  Amino LAMANid sequence of fusion protein of the Fab heavy chain of humanized anti-hTfR antibody No. 3N and hLAMAN, Fab HC-GS20-LAMAN
EVQLVQSGAEVKKPGESLKISCKGSGYSFMNYWLGWVRQMPGKGLEWMGDIYPGGDYPTYSEKFKVQVTISADKSISTAYLQLSSLKASDTAMYYCARSGNYDEVAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

The invention claimed is:

1. An anti-human transferrin receptor antibody, wherein the heavy chain variable region of the antibody comprises,
   (a) CDR1 comprising the amino acid sequence of SEQ ID NO: 62 or SEQ ID NO: 63,
   (b) CDR2 comprising the amino acid sequence of SEQ ID NO: 13 or SEQ ID NO: 14, and
   (c) CDR3 comprising the amino acid sequence of SEQ ID NO: 15 or SEQ ID NO: 16, and the light chain variable region of the antibody comprises, (a) CDR1 comprising the amino acid sequence of SEQ ID NO: 6,
(b) CDR2 comprising the amino acid sequence of SEQ ID NO: 8, and
(c) CDR3 comprising the amino acid sequence of SEQ ID NO: 10.

2. The antibody according to claim 1, wherein the framework region 3 of the heavy chain comprises the amino acid sequence of SEQ ID NO: 64.

3. The antibody according to claim 2, wherein the heavy chain variable region comprises the amino acid sequence of SEQ ID NO: 65.

4. The antibody according to claim 3, wherein the heavy chain comprises the amino acid sequence of SEQ ID NO: 66 or SEQ ID NO: 68.

5. The antibody according to claim 1, wherein the antibody comprises an amino acid sequence having sequence identity not lower than 80% to the amino acid sequence of the light chain variable region of SEQ ID NO: 17, SEQ ID NO: 18, SEQ ID NO: 19, SEQ ID NO: 20, SEQ ID NO: 21 or SEQ ID NO: 22, and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

6. The antibody according to claim 1, wherein the antibody comprises an amino acid sequence having a sequence identity not lower than 90% to the amino acid sequence of the light chain variable region of SEQ ID NO: 17, SEQ ID NO: 18, SEQ ID NO: 19, SEQ ID NO: 20, SEQ ID NO: 21 or SEQ ID NO: 22, and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

7. The antibody according to claim 1, wherein the antibody comprises an amino acid sequence modified from the amino acid sequence of the light chain variable region of SEQ ID NO: 17, SEQ ID NO: 18, SEQ ID NO: 19, SEQ ID NO: 20, SEQ ID NO: 21 or SEQ ID NO: 22 by the substitution, deletion or addition of 1 to 5 amino acids, in place thereof and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

8. The antibody according to claim 1, wherein the antibody comprises an amino acid sequence modified from the amino acid sequence of the light chain variable region of SEQ ID NO: 17, SEQ ID NO: 18, SEQ ID NO: 19, SEQ ID NO: 20, SEQ ID NO: 21 or SEQ ID NO: 22 by the substitution, deletion or addition of 1 to 3 amino acids, and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

9. The antibody according to claim 1, wherein the antibody comprises an amino acid sequence having sequence identity not lower than 80% to the amino acid sequence of the light chain of SEQ ID NO: 23, SEQ ID NO: 25, SEQ ID NO: 27 or SEQ ID NO: 29, and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

10. The antibody according to claim 1, wherein the antibody comprises an amino acid sequence having sequence identity not lower than 90% to the amino acid sequence of the light chain of SEQ ID NO: 23, SEQ ID NO: 25, SEQ ID NO: 27 or SEQ ID NO: 29, and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

11. The antibody according to claim 1, wherein the antibody comprises an amino acid sequence modified from the amino acid sequence of the light chain of SEQ ID NO: 23, SEQ ID NO: 25, SEQ ID NO: 27 or SEQ ID NO: 29 by the substitution, deletion or addition of 1 to 5 amino acids, and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

12. The antibody according to claim 1, wherein the antibody comprises an amino acid sequence modified from the amino acid sequence of the light chain of SEQ ID NO: 23, SEQ ID NO: 25, SEQ ID NO: 27 or SEQ ID NO: 29 by the substitution, deletion or addition of 1 to 3 amino acids, and in the light chain variable region of the antibody,
(a) CDR1 comprises the amino acid sequence of SEQ ID NO: 6,
(b) CDR2 comprises the amino acid sequence of SEQ ID NO: 8, and
(c) CDR3 comprises the amino acid sequence of SEQ ID NO: 10.

13. The antibody according to claim 1, wherein the antibody has an affinity to both the extracellular region of human transferrin receptor and the extracellular region of monkey transferrin receptor.

14. The antibody according to claim 13, wherein the dissociation constant of its complex with the extracellular region of human transferrin receptor is not greater than $1 \times 10^{-10}$ M, and the dissociation constant of its complex with the extracellular region of monkey transferrin receptor is not greater than $1 \times 10^{-10}$ M.

15. The antibody according to claim 1, wherein the antibody is Fab antibody, F(ab')$_2$ antibody, or F(ab') antibody.

16. The anti-human transferrin receptor antibody according to claim 1, wherein the antibody is a single-chain antibody selected from the group consisting of scFab, scF(ab'), scF(ab')$_2$ and scFv.

17. The antibody according to claim 16, wherein the light chain and the heavy chain thereof are linked via a linker sequence.

18. The antibody according to claim 17, wherein the heavy chain is linked, via a linker sequence, to the light chain on the C-terminal side of the light chain.

19. The antibody according to claim 17, wherein the linker sequence consists of g 2 to 50 amino acid residues.

20. The antibody according to claim 19, wherein the linker sequence is selected from the group consisting of the amino acid sequence Gly-Ser, the amino acid sequence Gly-Gly-Ser, the amino acid sequence Gly-Gly-Gly, the amino acid sequences set forth as SEQ ID NO: 3, SEQ ID NO: 4, SEQ ID NO: 5, the amino acid sequence consisting of three consecutively linked amino acid sequences each set forth as SEQ ID NO: 3, and the amino acid sequence consisting of 2 to 10 of any of said amino acid sequences that are consecutively linked.

21. The antibody according to claim 16, wherein the light chain is linked, via a linker sequence, to the heavy chain on the C-terminal side of the heavy chain.

22. A fusion protein comprising an anti-human transferrin receptor antibody and a different protein (A), wherein the anti-human transferrin receptor antibody is the antibody according to claim 1, and the protein (A) is linked to the light chain of the antibody on the C-terminal side or the N-terminal side of the light chain.

23. The fusion protein according to claim 22, wherein the protein (A) is linked, directly or via a linker, to the light chain on the C-terminal side or the N-terminal side of the light chain.

24. The fusion protein according to claim 22, wherein the protein (A) is linked, via a linker, to the light chain on the C-terminal side or the N-terminal side of the light chain.

25. The fusion protein according to claim 24, wherein the linker is a peptide consisting of 1 to 50 amino acid residues.

26. The fusion protein according to claim 25, wherein the linker is a peptide comprising an amino acid sequence selected from the group consisting of a single glycine, a single serine, the amino acid sequence Gly-Ser, the amino acid sequence Gly-Gly-Ser, the amino acid sequence of SEQ ID NO: 3, the amino acid sequence of SEQ ID NO: 4, the amino acid sequence of SEQ ID NO: 5, and the amino acid sequence consisting of 2 to 10 of any of said amino acid sequences that are consecutively linked.

27. A method for the production of a fusion protein according to claim 22, comprising a step of culturing mammalian cells transformed with an expression vector comprising a DNA fragment that is incorporated therein encoding the amino acid sequence of the fusion protein to let the mammalian cells secrete the fusion protein in the culture medium.

28. A fusion protein of an anti-human transferrin receptor antibody and a different protein (A), wherein the anti-human transferrin receptor antibody is the antibody according to claim 1, and the protein (A) is linked to the heavy chain of the antibody on the C-terminal side or the N-terminal side of the heavy chain.

29. The fusion protein according to claim 28, wherein the protein (A) is linked, directly or via a linker, to the heavy chain on the C-terminal side or the N-terminal side of the heavy chain.

30. The fusion protein according to claim 28, wherein the protein (A) is linked, via a linker, to the heavy chain on the C-terminal side or the N-terminal side of the heavy chain.

31. The fusion protein according to claim 30, wherein the linker sequence is a peptide consisting of 1 to 50 amino acid residues.

32. The fusion protein according to claim 31, wherein the linker is a peptide comprising an amino acid sequence selected from the group consisting of a single glycine, a single serine, the amino acid sequence Gly-Ser, the amino acid sequence Gly-Gly-Ser, the amino acid sequence of SEQ ID NO: 3, the amino acid sequence of SEQ ID NO: 4, the amino acid sequence of SEQ ID NO: 5, and the amino acid sequence consisting of 2 to 10 of any of said amino acid sequences that are consecutively linked.

33. The fusion protein according to claim 28, wherein the protein (A) is a protein originating from human.

34. The fusion protein according to claim 28, wherein the protein (A) is selected from the group consisting of nerve growth factor (NGF), lysosomal enzymes, ciliary neurotrophic factor (CNTF), glial cell line-derived neurotrophic factor (GDNF), neurotrophin-3, neurotrophin-4/5, neurotrophin-6, neuregulin-1, erythropoietin, darbepoetin, activin, basic fibroblast growth factor (bFGF), fibroblast growth factor 2 (FGF2), epidermal growth factor (EGF), vascular endothelial growth factor (VEGF), interferon α, interferon β, interferon γ, interleukin 6, granulocyte-macrophage colony stimulating factor (GM-CSF), granulocyte colony stimulating factor (G-CSF), macrophage colony stimulating factor (M-CSF), cytokines, tumor necrosis factor α receptor (TNF-α receptor), PD-1 ligands, PD-L1, PD-L2 enzymes having β-amyloid-degrading activity, anti-β-amyloid antibody, anti-BACE antibody, anti-EGFR antibody, anti-PD-1 antibody, anti-PD-L1 antibody, anti-PD-L2 antibody, anti-HER2 antibody, anti-TNF-α antibody, and anti-CTLA-4 antibody.

35. The fusion protein according to claim 28, wherein the protein (A) is a lysosomal enzyme, and the lysosomal enzyme is selected from the group consisting of α-L-iduronidase, iduronate 2-sulfatase, human acidic α-glucosidase, glucocerebrosidase, β-galactosidase, GM2 activator protein, β-hexosaminidase A, β-hexosaminidase B, N-acetylglucosamine-1-phosphotransferase, α-mannosidase, β-mannosidase, galactosylceramidase, saposin C, arylsulfatase A, α-L-fucosidase, aspartylglucosaminidase, α-N-acetylgalactosaminidase, acidic sphingomyelinase, α-galactosidase A, β-glucuronidase, heparan N-sulfatase, α-N-acetylglucosaminidase, acetyl CoA:α-α-glucosaminide N-acetyltransferase, N-acetylglucosamine-6-sulfate sulfatase, acid ceramidase, amylo-1,6-glucosidase, sialidase, palmitoyl protein thioesterase 1, tripeptidyl-peptidase 1, hyaluronidase 1, CLN1 and CLN2.

36. The fusion protein according to claim 28, wherein the protein (A) is human iduronate 2-sulfatase, human acidic α-glucosidase, or human α-L-iduronidase.

37. A method for the treatment of a disease of the central nervous system accompanying Pompe's disease comprising parenterally administering a therapeutically effective amount of the fusion protein according to claim 36 to a patient with the disease.

38. A method for the treatment of a disease of the central nervous system accompanying Hurler syndrome or Hurler-Scheie syndrome, the method comprising parenterally administering a therapeutically effective amount of the fusion protein according to claim 36 to a patient with the disease.

39. The fusion protein according to claim 28, wherein a human IgG Fc region or part thereof is introduced between the protein (A) and the antibody.

40. The fusion protein according to claim 39, wherein the human IgG Fc region is linked, directly or via a linker sequence, to the protein (A) on the C-terminal side of the protein (A), and the heavy chain or the light chain of the antibody is linked, directly or via a linker sequence, to the human IgG Fc region on the C-terminal side of the human IgG Fc region.

41. The fusion protein according to claim 39, wherein the human IgG Fc region comprises the amino acid sequence of SEQ ID NO: 70.

42. The fusion protein according to claim 41, wherein the human IgG Fc region is linked, via a linker sequence, to a Fab heavy chain consisting of the amino acid sequence of SEQ ID NO: 61, and comprises the amino acid sequence of SEQ ID NO: 71 formed thereby.

43. A DNA fragment encoding the amino acid sequence of the fusion protein according to claim 28.

44. A method for the production of a fusion protein according to claim 28, comprising a step of culturing mammalian cells transformed with an expression vector comprising a DNA fragment that is incorporated therein encoding the amino acid sequence of the fusion protein to let the mammalian cells secrete the fusion protein in the culture medium.

45. A DNA fragment encoding the amino acid sequence of the anti-human transferrin receptor antibody according to claim 1.

46. An expression vector comprising the DNA fragment according to claim 45.

47. A mammalian cell transformed with the expression vector according to claim 46.

* * * * *